United States Patent 12,569,549 (FLAVIVIRUS VACCINE) - sequence listing, part 30

SEQ ID NO: 12077 - RNA, 9876 nt, synthetic construct
  misc_feature 1..9876: note = derived and/or modified CDS sequence (opt2) from DENV-2__EU482720__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgccaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcacctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12078 - RNA, 9876 nt, synthetic construct
  misc_feature 1..9876: note = derived and/or modified CDS sequence (opt2) from DENV-2__EU482721__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccaccatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12079 - RNA, 9876 nt, synthetic construct
  misc_feature 1..9876: note = derived and/or modified CDS sequence (opt2) from DENV-2__EU482722__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgtcgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagaccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12080 - RNA, 9876 nt, synthetic construct
  misc_feature 1..9876: note = derived and/or modified CDS sequence (opt2) from DENV-2__EU482723__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagcgcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12081 - RNA, 9876 nt, synthetic construct
  misc_feature 1..9876: note = derived and/or modified CDS sequence (opt2) from DENV-2__EU482724__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacacctcccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12082 - RNA, 9876 nt, synthetic construct
  misc_feature 1..9876: note = derived and/or modified CDS sequence (opt2) from DENV-2__EU482725__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgacaccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgagatcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtccgcaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccagctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12083 - RNA, 9876 nt, synthetic construct
  misc_feature 1..9876: note = derived and/or modified CDS sequence (opt2) from DENV-2__EU482726__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcatcggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggacgcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccgtcgtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12084 - RNA, 9876 nt, synthetic construct
  misc_feature 1..9876: note = derived and/or modified CDS sequence (opt2) from DENV-2__EU482727__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcctactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgccgcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12085 - RNA, 9876 nt, synthetic construct
  misc_feature 1..9876: note = derived and/or modified CDS sequence (opt2) from DENV-2__EU482728__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccctcgtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12086 - RNA, 9876 nt, synthetic construct
  misc_feature 1..9876: note = derived and/or modified CDS sequence (opt2) from DENV-2__EU482729__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgagatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagatcgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcatcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcctactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgccgcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12087 - RNA, 9876 nt, synthetic construct
  misc_feature 1..9876: note = derived and/or modified CDS sequence (opt2) from DENV-2__EU482731__SS-prME
  source 1..9876: mol_type = other RNA
accgccggcgtcatcgtcatgctcatccccaccgtcatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggacgcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcccacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12088 - RNA, 9876 nt, synthetic construct
  misc_feature 1..9876: note = derived and/or modified CDS sequence (opt2) from DENV-2__EU482732__SS-prME
  source 1..9876: mol_type = other RNA
accgtcggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgccttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcacaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12089 - RNA, 9876 nt, synthetic construct
  misc_feature 1..9876: note = derived and/or modified CDS sequence (opt2) from DENV-2__EU482733__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12090 - RNA, 9876 nt, synthetic construct
  misc_feature 1..9876: note = derived and/or modified CDS sequence (opt2) from DENV-2__EU482734__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcatgatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatccgcaacgaggaggaggagcagaccctcaccatcctcatccgcaccggcctcctcgtcatctccggcgtcttccccgtctccatccccgtcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatcaccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12091 - RNA, 9876 nt, synthetic construct
  misc_feature 1..9876: note = derived and/or modified CDS sequence (opt2) from DENV-2__EU482735__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcatgatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggccctcaagatcgtcaagaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatccgcaacgaggaggaggagcagaccctcaccatcctcatccgcaccggcctcctcgtcatctccggcgtcttccccgtctccatccccgtcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcgtctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcaccatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12092 - RNA, 9876 nt, synthetic construct
  misc_feature 1..9876: note = derived and/or modified CDS sequence (opt2) from DENV-2__EU482736__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgtcgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctctccatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12093 - RNA, 9876 nt, synthetic construct
  misc_feature 1..9876: note = derived and/or modified CDS sequence (opt2) from DENV-2__EU482737__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgtcgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctctccatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12094 - RNA, 9876 nt, synthetic construct
  misc_feature 1..9876: note = derived and/or modified CDS sequence (opt2) from DENV-2__EU482739__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacctcgagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcttcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggccgcggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagaacgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12095 - RNA, 9876 nt, synthetic construct
  misc_feature 1..9876: note = derived and/or modified CDS sequence (opt2) from DENV-2__EU482740__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcagcccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagcgcgtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcgtcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12096 - RNA, 9876 nt, synthetic construct
  misc_feature 1..9876: note = derived and/or modified CDS sequence (opt2) from DENV-2__EU482741__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgtcgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12097 - RNA, 9876 nt, synthetic construct
  misc_feature 1..9876: note = derived and/or modified CDS sequence (opt2) from DENV-2__EU482742__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgcccccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12098 - RNA, 9876 nt, synthetic construct
  misc_feature 1..9876: note = derived and/or modified CDS sequence (opt2) from DENV-2__EU482744__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtctccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcaaggaggaggaggaggccggcgtcctctggtga

SEQ ID NO: 12099 - RNA, 9876 nt, synthetic construct
  misc_feature 1..9876: note = derived and/or modified CDS sequence (opt2) from DENV-2__EU482745__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccgcaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccaccaaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtcaagtccctcatcggcaacgaggagtacaccgactacatgccctccatgaagcgcttccgccgcgaggaggaggaggccggcgtcctctggtga

SEQ ID NO: 12100 - RNA, 9876 nt, synthetic construct
  misc_feature 1..9876: note = derived and/or modified CDS sequence (opt2) from DENV-2__EU482746__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccgcaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12101 - RNA, 9876 nt, synthetic construct
  misc_feature 1..9876: note = derived and/or modified CDS sequence (opt2) from DENV-2__EU482590__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccgtcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcctcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacatctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12102 - RNA, 9876 nt, synthetic construct
  misc_feature 1..9876: note = derived and/or modified CDS sequence (opt2) from DENV-2__EU482594__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcgccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcatcacctacctcgccctcctcgccgccttcaaggtccgccccaccttcgccgccggcctcctcctcaagaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgagggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12103 - RNA, 9876 nt, synthetic construct
  misc_feature 1..9876: note = derived and/or modified CDS sequence (opt2) from DENV-2__EU482604__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12104 - RNA, 9876 nt, synthetic construct
  misc_feature 1..9876: note = derived and/or modified CDS sequence (opt2) from DENV-2__EU482605__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcgtcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggccaaccccgagatcgaggacgccatcttccgcaagaagcgcctcaccatcatggacctccaccccggcgccggcaagcccaagcgctccctccccgccatcgtccgcgaggccatcaagcgcggcctccgccccctcatcctcgcccccccccgcgtcgtccccgccgagatggaggagcccctccgcggcctccccatccgctaccagacccccgccatcaagcccgaccacaccggccgcgagatcgtcgccctcatgtgccacgcccccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagcgcctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12105 - RNA, 9876 nt, synthetic construct
  misc_feature 1..9876: note = derived and/or modified CDS sequence (opt2) from DENV-2__EU482606__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccaccccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12106 - RNA, 9876 nt, synthetic construct
  misc_feature 1..9876: note = derived and/or modified CDS sequence (opt2) from DENV-2__EU482607__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcgtctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcatcgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccgacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcacccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12107 - RNA, 9876 nt, synthetic construct
  misc_feature 1..9876: note = derived and/or modified CDS sequence (opt2) from DENV-2__EU482608__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagcgcctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagatcaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12108 - RNA, 9876 nt, synthetic construct
  misc_feature 1..9876: note = derived and/or modified CDS sequence (opt2) from DENV-2__EU687220__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccatcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccacgccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12109 - RNA, 9876 nt, synthetic construct
  misc_feature 1..9876: note = derived and/or modified CDS sequence (opt2) from DENV-2__EU726775__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttccgcaccaacaccggcaccatcggcgccatctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttccgctccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12110 - RNA, 9876 nt, synthetic construct
  misc_feature 1..9876: note = derived and/or modified CDS sequence (opt2) from DENV-2__FJ639732__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccgtcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12111 - RNA, 9876 nt, synthetic construct
  misc_feature 1..9876: note = derived and/or modified CDS sequence (opt2) from DENV-2__FJ639733__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgaggccaccatgcgcggcgccaagcgcatggccatcctcggcgacaccgcctgggacttcggctccctcggcggcgccttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaagatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12112 - RNA, 9876 nt, synthetic construct
  misc_feature 1..9876: note = derived and/or modified CDS sequence (opt2) from DENV-2__FJ639734__SS-prME
  source 1..9876: mol_type = other RNA
accgccggcgtcatcgtcatgctcatccccaccgccatcgccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacctctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgaggtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgccctcgtcgtcccctgccgcaaccaggacgagctcatcggccgcgcccgcacctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12113 - RNA, 9876 nt, synthetic construct
  misc_feature 1..9876: note = derived and/or modified CDS sequence (opt2) from DENV-2__JN819408__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacatcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttccgcaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcatcacccaggagtccgagaacaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagggcgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12114 - RNA, 9876 nt, synthetic construct
  misc_feature 1..9876: note = derived and/or modified CDS sequence (opt2) from DENV-2__FJ639783__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcgtctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12115 - RNA, 9876 nt, synthetic construct
  misc_feature 1..9876: note = derived and/or modified CDS sequence (opt2) from DENV-2__FJ639788__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccgccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcgtctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaactacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12116 - RNA, 9876 nt, synthetic construct
  misc_feature 1..9876: note = derived and/or modified CDS sequence (opt2) from DENV-2__FJ639822__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcgtctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcatcgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccgtcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcgccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcacccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12117 - RNA, 9876 nt, synthetic construct
  misc_feature 1..9876: note = derived and/or modified CDS sequence (opt2) from DENV-2__FJ850112__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgccttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaagatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12118 - RNA, 9876 nt, synthetic construct
  misc_feature 1..9876: note = derived and/or modified CDS sequence (opt2) from DENV-2__FJ850105__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgccgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12119 - RNA, 9876 nt, synthetic construct
  misc_feature 1..9876: note = derived and/or modified CDS sequence (opt2) from DENV-2__FJ850106__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccaccctcctcgtcgccgcctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12120 - RNA, 9876 nt, synthetic construct
  misc_feature 1..9876: note = derived and/or modified CDS sequence (opt2) from DENV-2__FJ850107__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtcttccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggcaagctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatccgccaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12121 - RNA, 9876 nt, synthetic construct
  misc_feature 1..9876: note = derived and/or modified CDS sequence (opt2) from DENV-2__FJ850108__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagatcgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcatgatggtcatggtcggcgccaccatgaccgacgacatcggcatgggcgtcacctacctcgccctcctcgccgccttcaaggtccgccccaccttcgtcgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12122 - RNA, 9876 nt, synthetic construct
  misc_feature 1..9876: note = derived and/or modified CDS sequence (opt2) from DENV-2__JN819407__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtccctcggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctcttcaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12123 - RNA, 9876 nt, synthetic construct
  misc_feature 1..9876: note = derived and/or modified CDS sequence (opt2) from DENV-2__FJ898465__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatgctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaactaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccacgccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12124 - RNA, 9876 nt, synthetic construct
  misc_feature 1..9876: note = derived and/or modified CDS sequence (opt2) from DENV-2__FJ898466__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagcgcgcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacatcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttccgcaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagcgcaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgctcccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12125 - RNA, 9876 nt, synthetic construct
  misc_feature 1..9876: note = derived and/or modified CDS sequence (opt2) from DENV-2__FJ898467__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcatccagtacgagggcgacggctccccctgcaagatccccttcgagatcaccgacctcgagaagcgccacgtcctcggccgcctcatcaccgtcaaccccatcgtcatcgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacaccaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccgcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12126 - RNA, 9876 nt, synthetic construct
  misc_feature 1..9876: note = derived and/or modified CDS sequence (opt2) from DENV-2__GQ868595__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgcgcggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatcaagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12127 - RNA, 9876 nt, synthetic construct
  misc_feature 1..9876: note = derived and/or modified CDS sequence (opt2) from DENV-2__GQ868540__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcgtcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12128 - RNA, 9876 nt, synthetic construct
  misc_feature 1..9876: note = derived and/or modified CDS sequence (opt2) from DENV-2__GQ868541__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccacgccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcaccacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12129 - RNA, 9876 nt, synthetic construct
  misc_feature 1..9876: note = derived and/or modified CDS sequence (opt2) from DENV-2__GQ868603__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcctctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcctctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgccgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgtcgtcaccatcatggccatctcctgcgtccccaacgccgtcatcctccagaacgcctggaaggtctcctgcaccatcctcgccgccgtctccgtctcccccctcctcctcacctcctcccgccagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcttcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagatcccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12130 - RNA, 9876 nt, synthetic construct
  misc_feature 1..9876: note = derived and/or modified CDS sequence (opt2) from DENV-2__FJ898450__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgccttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctaccgcacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12131 - RNA, 9876 nt, synthetic construct
  misc_feature 1..9876: note = derived and/or modified CDS sequence (opt2) from DENV-2__FJ898453__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagcgccaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgtctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcgcccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12132 - RNA, 9876 nt, synthetic construct
  misc_feature 1..9876: note = derived and/or modified CDS sequence (opt2) from DENV-2__EU482445__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccctcaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12133 - RNA, 9876 nt, synthetic construct
  misc_feature 1..9876: note = derived and/or modified CDS sequence (opt2) from DENV-2__EU482446__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12134 - RNA, 9876 nt, synthetic construct
  misc_feature 1..9876: note = derived and/or modified CDS sequence (opt2) from DENV-2__EU482448__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagatctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12135 - RNA, 9876 nt, synthetic construct
  misc_feature 1..9876: note = derived and/or modified CDS sequence (opt2) from DENV-2__EU482449__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaacaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgttctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12136 - RNA, 9876 nt, synthetic construct
  misc_feature 1..9876: note = derived and/or modified CDS sequence (opt2) from DENV-2__EU482450__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccgccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacgccgactacatgccctccatgaagcgcttccgccgcgaggaggaggaggccggcgtcctctggtga

SEQ ID NO: 12137 - RNA, 9876 nt, synthetic construct
  misc_feature 1..9876: note = derived and/or modified CDS sequence (opt2) from DENV-2__EU569721__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccctccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12138 - RNA, 9876 nt, synthetic construct
  misc_feature 1..9876: note = derived and/or modified CDS sequence (opt2) from DENV-2__EU482451__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccggcgccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagaccaagaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaacgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12139 - RNA, 9876 nt, synthetic construct
  misc_feature 1..9876: note = derived and/or modified CDS sequence (opt2) from DENV-2__EU660413__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcttcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcatcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctctcccccaccgccatcttcctcaccaccctctcccgctccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggcggcatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagaagcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12140 - RNA, 9876 nt, synthetic construct
  misc_feature 1..9876: note = derived and/or modified CDS sequence (opt2) from DENV-2__EU660414__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggcaaccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcatcaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggctcccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12141 - RNA, 9876 nt, synthetic construct
  misc_feature 1..9876: note = derived and/or modified CDS sequence (opt2) from DENV-2__EU660415__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcggccccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgcctcggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagggcatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgtcatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12142 - RNA, 9876 nt, synthetic construct
  misc_feature 1..9876: note = derived and/or modified CDS sequence (opt2) from DENV-2__EU687249__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacatcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccgcgaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggccgcgtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggtccgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12143 - RNA, 9876 nt, synthetic construct
  misc_feature 1..9876: note = derived and/or modified CDS sequence (opt2) from DENV-2__EU660416__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagcgccgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcatgaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaacaaggtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12144 - RNA, 9876 nt, synthetic construct
  misc_feature 1..9876: note = derived and/or modified CDS sequence (opt2) from DENV-2__EU660417__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagcgccgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggctcccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaacaaggtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12145 - RNA, 9876 nt, synthetic construct
  misc_feature 1..9876: note = derived and/or modified CDS sequence (opt2) from DENV-2__EU677137__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcaccgtcaccgaggactgcggctcccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccgtcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccatgcagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12146 - RNA, 9876 nt, synthetic construct
  misc_feature 1..9876: note = derived and/or modified CDS sequence (opt2) from DENV-2__EU677138__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggccgcgccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgccaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12147 - RNA, 9876 nt, synthetic construct
  misc_feature 1..9876: note = derived and/or modified CDS sequence (opt2) from DENV-2__EU677149__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagcgccgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaacaaggtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12148 - RNA, 9876 nt, synthetic construct
  misc_feature 1..9876: note = derived and/or modified CDS sequence (opt2) from DENV-2__FJ024452__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcggccaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccggcaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcatcaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcatcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcgcccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12149 - RNA, 9876 nt, synthetic construct
  misc_feature 1..9876: note = derived and/or modified CDS sequence (opt2) from DENV-2__FJ205877__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagcgccgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactaccccgaccgccgctggtgcttcgacggcatcaagaacaaccagatcctcgaggagaacgtcgaggtcgagatctggcccaaggagggcgagcgcaagaagctcaagccccgctggctcgacccccgcatctactccgagccccgcgccctcaaggagttcaaggagttcccccccggccgcaagtccctcaccctcaacctcatcaccgagatgggccgcctccccaccttcatgacccagaagacccgcgacgccctcgacaacctcgccggcctccacaccgccgaggccggcggccgcgccgacaaccacgccctctccgagctcgccgagaccctcgagaccctcctcctcctcaccctcctcgccaccggcaccggcggcatcttcctcttcctcatgtccggccgcggcatcggcaagatgaccctcggcatgtgctgcatcatcaccgcctccatcctcctctgggacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcggcgccaccatgcccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctgggccctcgccaagatggacatcggcgtccccctcctcggcatcggctgctactcccaggtcaaccccatcaccctcaccggcgccctcctcctcctcggcggccactacgccatcatcggccccggcctccaggccaaggccacccgcgaggcccagaagcgcgccgcccccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcgcccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggaccccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaaggcctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgccacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctcccccgcatggccatctccggcgacgactgcgtcgtcaagcccctcgacgcccgcttcgccaacgccctcaccgccctcaacgccatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaacaaggtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12150 - RNA, 9876 nt, synthetic construct
  misc_feature 1..9876: note = derived and/or modified CDS sequence (opt2) from DENV-2__FJ024454__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggccccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgagaacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggcccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaccggcgtcgtccgcctcctcaccaagccctgggacgtcctccccaccgtcacccagatggccatgaccgacaccacccccttcggccagcagcgcgtcttcaaggagaaggtcgacacccgcacccaggaccccaaggaggccaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctccccgtcaccgaggaggtcgccgtccagaactggctcgcccgcgtcggccgcgagcgcctctcccgcatgcccatctccggcgacgactgcgtcgtcaagcccctcgacgcccgcttccccaccgccctcacccccctcaacgacatgggcaagatccgcaaggacatccaccagtgggacccctccaagggctggaacgactggacccaggtccccttctgctcccaccacttccacgagctcatcatgaaggacggccgcgtcctcgtcgtcccctgccgcaaccaggacgacctcatcgcccgcgcccgcatctcccagggccccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12151 - RNA, 9876 nt, synthetic construct
  misc_feature 1..9876: note = derived and/or modified CDS sequence (opt2) from DENV-2__FJ205878__SS-prME
  source 1..9876: mol_type = other RNA
tccgccggcatgatcatcatgctcatccccaccgtcaccgccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctaccgcgagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaccgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12152 - RNA, 9876 nt, synthetic construct
  misc_feature 1..9876: note = derived and/or modified CDS sequence (opt2) from DENV-2__FJ205879__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcaccaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacccccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12153 - RNA, 9876 nt, synthetic construct
  misc_feature 1..9876: note = derived and/or modified CDS sequence (opt2) from DENV-2__FJ390385__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgccaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtcggctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgctccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaccgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12154 - RNA, 9876 nt, synthetic construct
  misc_feature 1..9876: note = derived and/or modified CDS sequence (opt2) from DENV-2__FJ024458__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggccgccgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatggactactggatcgagtccgccctcaacgacacctggaagatcgagaaggcctccttcatcgaggtcaagaactgccactgggccaagtcccacaccctctggtccaacggcgtcctcgagtccgagatgatcatccccaagaacctcgccggccccgtctcccagcacaactaccgcctcggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12155 - RNA, 9876 nt, synthetic construct
  misc_feature 1..9876: note = derived and/or modified CDS sequence (opt2) from DENV-2__FJ205880__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgcctcctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12156 - RNA, 9876 nt, synthetic construct
  misc_feature 1..9876: note = derived and/or modified CDS sequence (opt2) from DENV-2__FJ390387__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaaggtccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcgtcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12157 - RNA, 9876 nt, synthetic construct
  misc_feature 1..9876: note = derived and/or modified CDS sequence (opt2) from DENV-2__FJ024461__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgcctcggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagggcatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12158 - RNA, 9876 nt, synthetic construct
  misc_feature 1..9876: note = derived and/or modified CDS sequence (opt2) from DENV-2__FJ373299__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactcccgcctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccggcggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12159 - RNA, 9876 nt, synthetic construct
  misc_feature 1..9876: note = derived and/or modified CDS sequence (opt2) from DENV-2__FJ410193__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcaccaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccgccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12160 - RNA, 9876 nt, synthetic construct
  misc_feature 1..9876: note = derived and/or modified CDS sequence (opt2) from DENV-2__FJ410195__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatcgtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcctccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12161 - RNA, 9876 nt, synthetic construct
  misc_feature 1..9876: note = derived and/or modified CDS sequence (opt2) from DENV-2__FJ432726__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgcctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12162 - RNA, 9876 nt, synthetic construct
  misc_feature 1..9876: note = derived and/or modified CDS sequence (opt2) from DENV-2__JF730049__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgtcgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaagacctggggcaaggccaagatgttctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctccgcatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcatcgaggagtacaccgactacatgccctccatgaagcgcttccgccgcgaggaggaggaggccggcgtcctctggtga

SEQ ID NO: 12163 - RNA, 9876 nt, synthetic construct
  misc_feature 1..9876: note = derived and/or modified CDS sequence (opt2) from DENV-2__FJ562098__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgccaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccatcgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatggtcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12164 - RNA, 9876 nt, synthetic construct
  misc_feature 1..9876: note = derived and/or modified CDS sequence (opt2) from DENV-2__FJ859028__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaagaacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12165 - RNA, 9876 nt, synthetic construct
  misc_feature 1..9876: note = derived and/or modified CDS sequence (opt2) from DENV-2__FJ410200__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcaacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgagaacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccgccagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgccgctgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12166 - RNA, 9876 nt, synthetic construct
  misc_feature 1..9876: note = derived and/or modified CDS sequence (opt2) from DENV-2__FJ410202__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccgtcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgaggtctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggtcggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacatcgactacatgccctccatgaagcgcttccgccgcgaggaggaggaggccggcgtcctctggtga

SEQ ID NO: 12167 - RNA, 9876 nt, synthetic construct
  misc_feature 1..9876: note = derived and/or modified CDS sequence (opt2) from DENV-2__FJ410208__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcaacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccgccagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgatcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12168 - RNA, 9876 nt, synthetic construct
  misc_feature 1..9876: note = derived and/or modified CDS sequence (opt2) from DENV-2__FJ461305__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagcgcgccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12169 - RNA, 9876 nt, synthetic construct
  misc_feature 1..9876: note = derived and/or modified CDS sequence (opt2) from DENV-2__FJ410215__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccgccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12170 - RNA, 9876 nt, synthetic construct
  misc_feature 1..9876: note = derived and/or modified CDS sequence (opt2) from DENV-2__FJ461309__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12171 - RNA, 9876 nt, synthetic construct
  misc_feature 1..9876: note = derived and/or modified CDS sequence (opt2) from DENV-2__FJ461311__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcaacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccgccagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccagctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12172 - RNA, 9876 nt, synthetic construct
  misc_feature 1..9876: note = derived and/or modified CDS sequence (opt2) from DENV-2__FJ410217__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcatcgtctcctggaagaacaaggagctcaagtgcggctccggcatcttcgtcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcttcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcgccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacgcccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12173 - RNA, 9876 nt, synthetic construct
  misc_feature 1..9876: note = derived and/or modified CDS sequence (opt2) from DENV-2__FJ410219__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatcctcatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgcttcctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcatgaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgatcaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgtcaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12174 - RNA, 9876 nt, synthetic construct
  misc_feature 1..9876: note = derived and/or modified CDS sequence (opt2) from DENV-2__FJ461314__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccctcaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12175 - RNA, 9876 nt, synthetic construct
  misc_feature 1..9876: note = derived and/or modified CDS sequence (opt2) from DENV-2__FJ410221__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccatcatggccgacgacatcggcatcggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagtccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgtcgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacgtcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12176 - RNA, 9876 nt, synthetic construct
  misc_feature 1..9876: note = derived and/or modified CDS sequence (opt2) from DENV-2__FJ547064__SS-prME
  source 1..9876: mol_type = other RNA
tccgccggcatgatcatcatgctcatccccaccgtcatggccttccacctcaccacccgcaacggcgagccccacatggtcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctaccgcgagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgtcgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacatccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaccgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12177 - RNA, 9876 nt, synthetic construct
  misc_feature 1..9876: note = derived and/or modified CDS sequence (opt2) from DENV-2__FJ410223__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggcgcacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcgccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctccggcaacctcaagaacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgtcgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12178 - RNA, 9876 nt, synthetic construct
  misc_feature 1..9876: note = derived and/or modified CDS sequence (opt2) from DENV-2__FJ410224__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccgtcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcaccgtcaccctctacctcggcgtcatggtccaggccgactccggctgcgtcgtctcctggaagtccaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12179 - RNA, 9876 nt, synthetic construct
  misc_feature 1..9876: note = derived and/or modified CDS sequence (opt2) from DENV-2__FJ461321__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcactccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccaacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagtccgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12180 - RNA, 9876 nt, synthetic construct
  misc_feature 1..9876: note = derived and/or modified CDS sequence (opt2) from DENV-2__FJ410228__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaacggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12181 - RNA, 9876 nt, synthetic construct
  misc_feature 1..9876: note = derived and/or modified CDS sequence (opt2) from DENV-2__FJ410233__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcaacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccgccagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12182 - RNA, 9876 nt, synthetic construct
  misc_feature 1..9876: note = derived and/or modified CDS sequence (opt2) from DENV-2__FJ410237__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggatcgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacgccgactacatgccctccatgaagcgcttccgccgcgaggaggaggaggccggcgtcctctggtga

SEQ ID NO: 12183 - RNA, 9876 nt, synthetic construct
  misc_feature 1..9876: note = derived and/or modified CDS sequence (opt2) from DENV-2__FJ410241__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctccgcatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagctcgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12184 - RNA, 9876 nt, synthetic construct
  misc_feature 1..9876: note = derived and/or modified CDS sequence (opt2) from DENV-2__FJ410259__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccaccaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgccgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12185 - RNA, 9876 nt, synthetic construct
  misc_feature 1..9876: note = derived and/or modified CDS sequence (opt2) from DENV-2__FJ547067__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccatctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccaggtctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggccgcaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12186 - RNA, 9876 nt, synthetic construct
  misc_feature 1..9876: note = derived and/or modified CDS sequence (opt2) from DENV-2__JN819418__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttctccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12187 - RNA, 9876 nt, synthetic construct
  misc_feature 1..9876: note = derived and/or modified CDS sequence (opt2) from DENV-2__EU482640__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccaccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggcgccagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccgtccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccgccagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccatgcgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12188 - RNA, 9876 nt, synthetic construct
  misc_feature 1..9876: note = derived and/or modified CDS sequence (opt2) from DENV-2__EU482641__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccatcaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12189 - RNA, 9876 nt, synthetic construct
  misc_feature 1..9876: note = derived and/or modified CDS sequence (opt2) from DENV-2__EU482642__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcttcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatctgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12190 - RNA, 9876 nt, synthetic construct
  misc_feature 1..9876: note = derived and/or modified CDS sequence (opt2) from DENV-2__EU482643__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatgaagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgacaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatgggcaacgaggagtacaccgactacatgccctccatgaagcgcttccgccgcgaggaggaggaggccggcgtcctctggtga

SEQ ID NO: 12191 - RNA, 9876 nt, synthetic construct
  misc_feature 1..9876: note = derived and/or modified CDS sequence (opt2) from DENV-2__EU482644__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcaccggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12192 - RNA, 9876 nt, synthetic construct
  misc_feature 1..9876: note = derived and/or modified CDS sequence (opt2) from DENV-2__EU482645__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagaaggtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcaccggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12193 - RNA, 9876 nt, synthetic construct
  misc_feature 1..9876: note = derived and/or modified CDS sequence (opt2) from DENV-2__EU482646__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcaccaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12194 - RNA, 9876 nt, synthetic construct
  misc_feature 1..9876: note = derived and/or modified CDS sequence (opt2) from DENV-2__EU482647__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatgaagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12195 - RNA, 9876 nt, synthetic construct
  misc_feature 1..9876: note = derived and/or modified CDS sequence (opt2) from DENV-2__EU482648__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12196 - RNA, 9876 nt, synthetic construct
  misc_feature 1..9876: note = derived and/or modified CDS sequence (opt2) from DENV-2__EU482649__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtctcctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagaacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12197 - RNA, 9876 nt, synthetic construct
  misc_feature 1..9876: note = derived and/or modified CDS sequence (opt2) from DENV-2__EU482650__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggcaagttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12198 - RNA, 9876 nt, synthetic construct
  misc_feature 1..9876: note = derived and/or modified CDS sequence (opt2) from DENV-2__EU482651__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcaccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12199 - RNA, 9876 nt, synthetic construct
  misc_feature 1..9876: note = derived and/or modified CDS sequence (opt2) from DENV-2__EU482652__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccctctgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccgccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccaccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacgccgactacatgccctccatgaagcgcttccgccgcgaggaggaggaggccggcgtcctctggtga

SEQ ID NO: 12200 - RNA, 9876 nt, synthetic construct
  misc_feature 1..9876: note = derived and/or modified CDS sequence (opt2) from DENV-2__EU482653__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcttcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacgcccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12201 - RNA, 9876 nt, synthetic construct
  misc_feature 1..9876: note = derived and/or modified CDS sequence (opt2) from DENV-2__EU482654__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagatgaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12202 - RNA, 9876 nt, synthetic construct
  misc_feature 1..9876: note = derived and/or modified CDS sequence (opt2) from DENV-2__EU482656__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcctcgacgaggagcgcgagatccccgagcgctcctggaactccggccacgagtgggtcaccgacttcgagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccgtcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12203 - RNA, 9876 nt, synthetic construct
  misc_feature 1..9876: note = derived and/or modified CDS sequence (opt2) from DENV-2__EU482657__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcatgcgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatggagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccaccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12204 - RNA, 9876 nt, synthetic construct
  misc_feature 1..9876: note = derived and/or modified CDS sequence (opt2) from DENV-2__EU482658__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcatcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgacaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12205 - RNA, 9876 nt, synthetic construct
  misc_feature 1..9876: note = derived and/or modified CDS sequence (opt2) from DENV-2__EU482659__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagcacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcgacgaggagtacaccgactacatgccctccatgaagcgcttccgccgcgaggaggaggaggccggcgtcctctggtga

SEQ ID NO: 12206 - RNA, 9876 nt, synthetic construct
  misc_feature 1..9876: note = derived and/or modified CDS sequence (opt2) from DENV-2__EU482661__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgagggcgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12207 - RNA, 9876 nt, synthetic construct
  misc_feature 1..9876: note = derived and/or modified CDS sequence (opt2) from DENV-2__EU482662__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagaaggccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12208 - RNA, 9876 nt, synthetic construct
  misc_feature 1..9876: note = derived and/or modified CDS sequence (opt2) from DENV-2__EU482663__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctccgcaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacatcgactacatgccctccatgaagcgcttccgccgcgaggaggaggaggccggcgtcctctggtga

SEQ ID NO: 12209 - RNA, 9876 nt, synthetic construct
  misc_feature 1..9876: note = derived and/or modified CDS sequence (opt2) from DENV-2__EU482664__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccgtcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12210 - RNA, 9876 nt, synthetic construct
  misc_feature 1..9876: note = derived and/or modified CDS sequence (opt2) from DENV-2__EU482665__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12211 - RNA, 9876 nt, synthetic construct
  misc_feature 1..9876: note = derived and/or modified CDS sequence (opt2) from DENV-2__EU482666__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcatgcgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12212 - RNA, 9876 nt, synthetic construct
  misc_feature 1..9876: note = derived and/or modified CDS sequence (opt2) from DENV-2__EU482667__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggaggccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatcaaggtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12213 - RNA, 9876 nt, synthetic construct
  misc_feature 1..9876: note = derived and/or modified CDS sequence (opt2) from DENV-2__EU482668__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12214 - RNA, 9876 nt, synthetic construct
  misc_feature 1..9876: note = derived and/or modified CDS sequence (opt2) from DENV-2__EU482669__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccgcctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggtcgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgactacaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaccatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12215 - RNA, 9876 nt, synthetic construct
  misc_feature 1..9876: note = derived and/or modified CDS sequence (opt2) from DENV-2__EU482670__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcatgaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccaggtcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12216 - RNA, 9876 nt, synthetic construct
  misc_feature 1..9876: note = derived and/or modified CDS sequence (opt2) from DENV-2__EU482671__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtccgcgagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12217 - RNA, 9876 nt, synthetic construct
  misc_feature 1..9876: note = derived and/or modified CDS sequence (opt2) from DENV-2__EU482674__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggccactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagaacatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagaagcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12218 - RNA, 9876 nt, synthetic construct
  misc_feature 1..9876: note = derived and/or modified CDS sequence (opt2) from DENV-2__EU482676__SS-prME
  source 1..9876: mol_type = other RNA
tccgcctccatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcaaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggccgcatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggacaaccgcgccgtccacgccgacatgggctactggatcgagtccgccctcaacgacacctggaagatcgagcgcgcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctccgcaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12219 - RNA, 9876 nt, synthetic construct
  misc_feature 1..9876: note = derived and/or modified CDS sequence (opt2) from DENV-2__EU482677__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagaccaagaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaacgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12220 - RNA, 9876 nt, synthetic construct
  misc_feature 1..9876: note = derived and/or modified CDS sequence (opt2) from DENV-2__EU482678__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacgagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcgccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaacaccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12221 - RNA, 9876 nt, synthetic construct
  misc_feature 1..9876: note = derived and/or modified CDS sequence (opt2) from DENV-2__EU482679__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgggcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12222 - RNA, 9876 nt, synthetic construct
  misc_feature 1..9876: note = derived and/or modified CDS sequence (opt2) from DENV-2__EU482774__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcttcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12223 - RNA, 9876 nt, synthetic construct
  misc_feature 1..9876: note = derived and/or modified CDS sequence (opt2) from DENV-2__EU482775__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12224 - RNA, 9876 nt, synthetic construct
  misc_feature 1..9876: note = derived and/or modified CDS sequence (opt2) from DENV-2__EU482776__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgcctacaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggcctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcatcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggctgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12225 - RNA, 9876 nt, synthetic construct
  misc_feature 1..9876: note = derived and/or modified CDS sequence (opt2) from DENV-2__EU482777__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12226 - RNA, 9876 nt, synthetic construct
  misc_feature 1..9876: note = derived and/or modified CDS sequence (opt2) from DENV-2__EU482778__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagaactgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatcggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccgtccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12227 - RNA, 9876 nt, synthetic construct
  misc_feature 1..9876: note = derived and/or modified CDS sequence (opt2) from DENV-2__EU482779__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12228 - RNA, 9876 nt, synthetic construct
  misc_feature 1..9876: note = derived and/or modified CDS sequence (opt2) from DENV-2__EU482780__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcatgctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12229 - RNA, 9876 nt, synthetic construct
  misc_feature 1..9876: note = derived and/or modified CDS sequence (opt2) from DENV-2__EU482781__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcagcccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctggaagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12230 - RNA, 9876 nt, synthetic construct
  misc_feature 1..9876: note = derived and/or modified CDS sequence (opt2) from DENV-2__EU482782__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgtcgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12231 - RNA, 9876 nt, synthetic construct
  misc_feature 1..9876: note = derived and/or modified CDS sequence (opt2) from DENV-2__EU482783__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcggcatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12232 - RNA, 9876 nt, synthetic construct
  misc_feature 1..9876: note = derived and/or modified CDS sequence (opt2) from DENV-2__EU482784__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcatcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12233 - RNA, 9876 nt, synthetic construct
  misc_feature 1..9876: note = derived and/or modified CDS sequence (opt2) from DENV-2__EU482785__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12234 - RNA, 9876 nt, synthetic construct
  misc_feature 1..9876: note = derived and/or modified CDS sequence (opt2) from DENV-2__EU482786__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacggcgactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccaagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12235 - RNA, 9876 nt, synthetic construct
  misc_feature 1..9876: note = derived and/or modified CDS sequence (opt2) from DENV-2__EU482787__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12236 - RNA, 9876 nt, synthetic construct
  misc_feature 1..9876: note = derived and/or modified CDS sequence (opt2) from DENV-2__EU482788__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12237 - RNA, 9876 nt, synthetic construct
  misc_feature 1..9876: note = derived and/or modified CDS sequence (opt2) from DENV-2__EU482697__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctaccgcgagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcaccgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacttccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12238 - RNA, 9876 nt, synthetic construct
  misc_feature 1..9876: note = derived and/or modified CDS sequence (opt2) from DENV-2__EU482699__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcatcctcggcatggccctcttcctcgaggagatgctccgcacccgcgtcggcaccaagcacgccatcctcctcgccgccgtctccttcgtcaccctcatcaccggcaacatgtccttcaaggacctcggccgcgtcatggtcatggtcggcgccaccatggccgacgacatcggcatgggcgtcacctacctcgccctcctcgccgccttcaaggtccgccccaccttcgccgccggcctcctcctccgccgcctcacctccaaggagctcatgatgaccaccatcggcatcgtcctcctctcccagtccaccatccccgagaccgtcctcgagctcaccgacgccctcgccctcggcatgatggtcctcaagatcgtccgcaagatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaagggcggcgagaagaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12239 - RNA, 9876 nt, synthetic construct
  misc_feature 1..9876: note = derived and/or modified CDS sequence (opt2) from DENV-2__EU482701__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacgccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccgtcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatggtcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcgtcgtcctcctctcccagtccaccatccccgacaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12240 - RNA, 9876 nt, synthetic construct
  misc_feature 1..9876: note = derived and/or modified CDS sequence (opt2) from DENV-2__EU482703__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtcggctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12241 - RNA, 9876 nt, synthetic construct
  misc_feature 1..9876: note = derived and/or modified CDS sequence (opt2) from DENV-2__EU482705__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacaacatcggcatgggcgtcacctacctcgccctcctcgccgccttcaaggtccgccccaccttcgccgccggcctcctcctccgccgcctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12242 - RNA, 9876 nt, synthetic construct
  misc_feature 1..9876: note = derived and/or modified CDS sequence (opt2) from DENV-2__EU482463__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagaagcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12243 - RNA, 9876 nt, synthetic construct
  misc_feature 1..9876: note = derived and/or modified CDS sequence (opt2) from DENV-2__EU482464__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcaccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcgccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12244 - RNA, 9876 nt, synthetic construct
  misc_feature 1..9876: note = derived and/or modified CDS sequence (opt2) from DENV-2__EU482465__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccaccgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcaccaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12245 - RNA, 9876 nt, synthetic construct
  misc_feature 1..9876: note = derived and/or modified CDS sequence (opt2) from DENV-2__EU482466__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccctccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12246 - RNA, 9876 nt, synthetic construct
  misc_feature 1..9876: note = derived and/or modified CDS sequence (opt2) from DENV-2__EU482467__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcaccgcaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccaccacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12247 - RNA, 9876 nt, synthetic construct
  misc_feature 1..9876: note = derived and/or modified CDS sequence (opt2) from DENV-2__EU482468__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcatgcgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatggagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccaccctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12248 - RNA, 9876 nt, synthetic construct
  misc_feature 1..9876: note = derived and/or modified CDS sequence (opt2) from DENV-2__EU482469__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcccacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagaacatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12249 - RNA, 9876 nt, synthetic construct
  misc_feature 1..9876: note = derived and/or modified CDS sequence (opt2) from DENV-2__EU482470__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatgaccatcctctgcgtccccaacgccgtcatcctccagaacgcctggaaggtctcctgcaccatcctcgccgtcgtctccgtctcccccctcctcctcacctcctcccgccagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12250 - RNA, 9876 nt, synthetic construct
  misc_feature 1..9876: note = derived and/or modified CDS sequence (opt2) from DENV-2__EU482471__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcactccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccaacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12251 - RNA, 9876 nt, synthetic construct
  misc_feature 1..9876: note = derived and/or modified CDS sequence (opt2) from DENV-2__EU482472__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatggagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcatcatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12252 - RNA, 9876 nt, synthetic construct
  misc_feature 1..9876: note = derived and/or modified CDS sequence (opt2) from DENV-2__EU482473__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggtcgccatcaaccaggtccgctccctcatcggcaacgaggagtacaccgactacatgccctccatgaagcgcttccgccgcgaggaggaggaggccggcgtcctctggtga

SEQ ID NO: 12253 - RNA, 9876 nt, synthetic construct
  misc_feature 1..9876: note = derived and/or modified CDS sequence (opt2) from DENV-2__EU482474__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccatcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctccgcctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccgtcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12254 - RNA, 9876 nt, synthetic construct
  misc_feature 1..9876: note = derived and/or modified CDS sequence (opt2) from DENV-2__EU482475__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgtcgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12255 - RNA, 9876 nt, synthetic construct
  misc_feature 1..9876: note = derived and/or modified CDS sequence (opt2) from DENV-2__EU482541__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcatggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccgccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcgcctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12256 - RNA, 9876 nt, synthetic construct
  misc_feature 1..9876: note = derived and/or modified CDS sequence (opt2) from DENV-2__EU482542__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaaggtccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcacctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctcaagacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcatcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12257 - RNA, 9876 nt, synthetic construct
  misc_feature 1..9876: note = derived and/or modified CDS sequence (opt2) from DENV-2__JX966380__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatgaaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacctccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagaccctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcaccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagaacatccagcacctcaccgcctccgaggagatcgccgtccaggactggctcgtccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaacaaggtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12258 - RNA, 9876 nt, synthetic construct
  misc_feature 1..9876: note = derived and/or modified CDS sequence (opt2) from DENV-2__JX966379__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctcaagcagaacgagcccgaggacatcgactgctggtgcaactccacctccacctgggtcacctacggcacctgcaccaccaccggcgagcaccgccgcggcaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgcctccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcgactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatggtcatccccaagaactacgccggccccgtctcccagcacaacaaccgccccggctaccacacccagaccgccggcccctggcacctcggcaagctcgagatggacttcgacttctgcgagggcaccaccgtcgtcgtcaccgaggagtgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgctcccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgcctacaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccacccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttccgcaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccacctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaacccccgcaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgcctccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggccacatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctccatcatgaagaacaccacctccacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcgtcccccccgagaagtgcgacaccctcctctgcgacatcggcgagtcctcccccaaccccaccgtcgaggccggccgcaccctccgcgtcctcaacctcgtcgagaactggctcaacgacaacacccagttctgcgtcaaggtcctcaacccctacatgccctccgtcatcgagcgcatggagaccctccagcgcaagtacggcggcgccctcgtccgcaaccccctctcccgcaactccacccacgagatgtactgggtctccaacgcctccggcaacgtcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgaggcctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacaaccgcttctgggagctcgtcgacaaggagcgcaacctccacctcgagggcaagtgcgagacctgcgtctacaacatgatgggcaagcgcgagaagaagctcggcgagttcggcaaggcccgcggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcatcttcaagtccatccagcacctcaccgcctccgaggagatcgccgtccaggactggctcgcccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatcctcgagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12259 - RNA, 9876 nt, synthetic construct
  misc_feature 1..9876: note = derived and/or modified CDS sequence (opt2) from DENV-2__KP012546__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatgcccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatctccacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccaccaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggaacctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12260 - RNA, 9876 nt, synthetic construct
  misc_feature 1..9876: note = derived and/or modified CDS sequence (opt2) from DENV-2__KP723478__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccatgtcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatgcccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccacccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatctccacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccaccaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggaacctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12261 - RNA, 9876 nt, synthetic construct
  misc_feature 1..9876: note = derived and/or modified CDS sequence (opt2) from DENV-2__KP723479__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagatgaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcgtctccggcctcttccccgtctccacccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagaacaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12262 - RNA, 9876 nt, synthetic construct
  misc_feature 1..9876: note = derived and/or modified CDS sequence (opt2) from DENV-2__KT187554__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatgcccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcttcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatctccacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccaccaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagcgcgagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggaacctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12263 - RNA, 9876 nt, synthetic construct
  misc_feature 1..9876: note = derived and/or modified CDS sequence (opt2) from DENV-2__KT187557__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccatgtcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatgcccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatctccacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccaccaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggaacctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12264 - RNA, 9876 nt, synthetic construct
  misc_feature 1..9876: note = derived and/or modified CDS sequence (opt2) from DENV-2__JQ045670__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccgccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaacgacctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12265 - RNA, 9876 nt, synthetic construct
  misc_feature 1..9876: note = derived and/or modified CDS sequence (opt2) from DENV-2__JQ045686__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgtcatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggccaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatcaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcaacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgtcggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacatggaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcgtcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12266 - RNA, 9876 nt, synthetic construct
  misc_feature 1..9876: note = derived and/or modified CDS sequence (opt2) from DENV-2__KU094070__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccgaggacggcgtcaacatgtgcaccctcatggccatggacctcggcgagtggctcgaggacaagatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggctccatcgtcacctgcgccatgttcacctgcaagaagatcatgaagggcaaggtcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggctacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcaccggcgtcatcatcacctggatcggcatgaactcccgctccacctccctctccgtctccctcgtcctcgtcggcgccgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgaggagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatggtccgcaagatggagaagtaccagctcgccgtcaccatcatggccatcctctgcgtccccaacgccgtcatcctccagaacgcctggaaggtctcctgcaccatcctcgccgtcgtctccgtctcccccctcttcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacgccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgcaagctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggtcctccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcaccctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgtcacctggggcaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12267 - RNA, 9876 nt, synthetic construct
  misc_feature 1..9876: note = derived and/or modified CDS sequence (opt2) from DENV-2__FM210215__SS-prME
  source 1..9876: mol_type = other RNA
tccgccggcatgatcgtcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaactccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagtccgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12268 - RNA, 9876 nt, synthetic construct
  misc_feature 1..9876: note = derived and/or modified CDS sequence (opt2) from DENV-2__FM210216__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccaccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12269 - RNA, 9876 nt, synthetic construct
  misc_feature 1..9876: note = derived and/or modified CDS sequence (opt2) from DENV-2__FM210217__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgaccaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatcggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctccaaggaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12270 - RNA, 9876 nt, synthetic construct
  misc_feature 1..9876: note = derived and/or modified CDS sequence (opt2) from DENV-2__JX286524__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 12271 - RNA, 9876 nt, synthetic construct
  misc_feature 1..9876: note = derived and/or modified CDS sequence (opt2) from DENV-2__JX286520__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcatcgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 12272 - RNA, 9876 nt, synthetic construct
  misc_feature 1..9876: note = derived and/or modified CDS sequence (opt2) from DENV-2__JX286525__SS-prME
  source 1..9876: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctggtga

SEQ ID NO: 12273 - RNA, 9876 nt, synthetic construct
  misc_feature 1..9876: note = derived and/or modified CDS sequence (opt2) from DENV-2__KM279598__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacgtcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12274 - RNA, 9876 nt, synthetic construct
  misc_feature 1..9876: note = derived and/or modified CDS sequence (opt2) from DENV-2__KM279576__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgcaccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaagatccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcacctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12275 - RNA, 9876 nt, synthetic construct
  misc_feature 1..9876: note = derived and/or modified CDS sequence (opt2) from DENV-2__KC964095__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgaccgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccccccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatcgtcgaccgcggctggggcaacggctgcggctccttcggcaagggcggcatcgtcacctgcgccatgttcacctgcaagaagaacatggagggcaagatcgtccagcccgagaacctcgagtacaccatcgtcgtcaccccccactccggcgaggagcacgccatcggcaacgacaccggcaagcacggcaaggagatcaaggtcaccccccagtcctccgtcaccgaggccgagctcaccggctacggcaccgtcaccatcgagtgctccccccgcaccggcctcgacttcaacgagatggtcctcctccagatgggcaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgcggcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccgcacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcaccatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcatgttcaccaccaacatctggctccagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcaccagggcaagcccgagatggacttcgacttctgcgacggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggccctcaagatcgtccgcgacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaactgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcgtcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcggcggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgagggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccagcagcccgagtccaacatcctcgacatcgacctcccccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtggtcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcggcaagatcaagcaggagcacgagacctcctggcactacgaccaggaccacccctacaagacctgggcctaccacggctcctacgagaccaagcagaccggctccgcctcctccatggtcgacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaaggagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgcccccccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagaacatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacgtcggcaagatccgcaaggacatccagcagtgggagccctcccgcggctgggacgactggacccaggtccccttctgctcccaccactcccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggagatcccctacctcggcaagcgcgagggccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12276 - RNA, 9876 nt, synthetic construct
  misc_feature 1..9876: note = derived and/or modified CDS sequence (opt2) from DENV-2__KC964094__SS-prME
  source 1..9876: mol_type = other RNA
tccgccggcatgatcatcatgctcatccccaccgtcatggccttccacctcaccacccgcaacggcgagccccacatgatcgtctccatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctccatcggcatctccaaccgcgacttcgtcgagggcgtctccggcggctcctgggtcgacgtcgtcctcgagcacggctcctgcgtcaccaccatggccaagaacaagcccaccctcgacttcgagctcaccaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccgtcaccgaggccgagctcaccggctacggcaccgtcaccatggagtgctccccccgcaccggcctcgacttcaacgagatggtcctcctccagatgaagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcaccgacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaaggagtcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagcgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcgccggccgctccgccgacctcgagctcgagcgcgccgccgacgtccgctgggaggagcaggccgagatctccggctcctcccccatcctctccatcaccatctccgaggacggcggcatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggagatccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacaccttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggccgcaaggtcatccagctctcccgcaagacctccgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtcggcaaccccctctcccgcaactccacccacgagatgtactgggcctccaacgcctccggcaacatcgtctcctccgtcaacatgatctcccgcatgctcatcaaccgcttcaccatgcgccacaagaaggccacctacgagcccgacgtcgacctcggctccggcacccgccacatcggcatcgagtccgagacccccaacctcgacatcatcggcaagcgcatcgagaagatcaagcaggagcacgagacctcctggcactgcgaccaggaccacccctacaagacctgggcctaccacggctcctacgaggccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaaggccccccgcatgtgcacccgcgaggagttcacccgcaaggtccgctccaacgccgccctcggcgccatgttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12277 - RNA, 9876 nt, synthetic construct
  misc_feature 1..9876: note = derived and/or modified CDS sequence (opt2) from DENV-2__KC964093__SS-prME
  source 1..9876: mol_type = other RNA
accgccggcgtcatcatcatgatgatccccaccgtcgtcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcaccaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgtcgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggccgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtcctcccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcgccggccgctccgccgacctcgagctcgagcgcgccgccgacgtccgctgggaggagcaggccgagatctccggctcctcccccatcctctccatcaccatctccgaggacggcggcatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggagatccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagcgcgtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacgacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgccatcgccatcctcaccgtcgtcgccgccaccatggccaacgagatgggcttcctcgagaagaccaagaaggacttcggcctcggctccatcgccacccagcagcccgagtccaacatcctcgacctcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgtcggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcgccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcacccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggagggcgaggccggcgtcctctggtga

SEQ ID NO: 12278 - RNA, 9876 nt, synthetic construct
  misc_feature 1..9876: note = derived and/or modified CDS sequence (opt2) from DENV-2__DQ448231__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacaccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatcctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 12279 - RNA, 9876 nt, synthetic construct
  misc_feature 1..9876: note = derived and/or modified CDS sequence (opt2) from DENV-2__JX470186__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgcccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagatgaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcgtctccggcctcttccccgtctccacccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagaacaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12280 - RNA, 9876 nt, synthetic construct
  misc_feature 1..9876: note = derived and/or modified CDS sequence (opt2) from DENV-2__KU517846__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcatgaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagctcaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctctccccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaagatccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12281 - RNA, 9876 nt, synthetic construct
  misc_feature 1..9876: note = derived and/or modified CDS sequence (opt2) from DENV-2__KJ830750__SS-prME
  source 1..9876: mol_type = other RNA
accgccggcgtcatcatcatgctcatccccaccgccatggccttccacctcaccacccgcaacggcgagccccacatgatcgtctccaagcaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacatccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctctccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccacccccgagtccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagaaggccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccatccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccggccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggctccgaggagtacaccgactacatgccctccatgaagcgcttccgccgcgaggaggaggaggccggcgtcctctggtga

SEQ ID NO: 12282 - RNA, 9876 nt, synthetic construct
  misc_feature 1..9876: note = derived and/or modified CDS sequence (opt2) from DENV-2__FM210231__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgtcacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagtccgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12283 - RNA, 9876 nt, synthetic construct
  misc_feature 1..9876: note = derived and/or modified CDS sequence (opt2) from DENV-2__FM210239__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgccgcaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12284 - RNA, 9876 nt, synthetic construct
  misc_feature 1..9876: note = derived and/or modified CDS sequence (opt2) from DENV-2__FM210232__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggcctgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12285 - RNA, 9876 nt, synthetic construct
  misc_feature 1..9876: note = derived and/or modified CDS sequence (opt2) from DENV-2__FM210233__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatccgcggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatggagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagcgcgacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccacaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12286 - RNA, 9876 nt, synthetic construct
  misc_feature 1..9876: note = derived and/or modified CDS sequence (opt2) from DENV-2__FM210241__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagttcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12287 - RNA, 9876 nt, synthetic construct
  misc_feature 1..9876: note = derived and/or modified CDS sequence (opt2) from DENV-2__FM210242__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcgtcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagtccgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12288 - RNA, 9876 nt, synthetic construct
  misc_feature 1..9876: note = derived and/or modified CDS sequence (opt2) from DENV-2__FM210243__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtcttccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12289 - RNA, 9876 nt, synthetic construct
  misc_feature 1..9876: note = derived and/or modified CDS sequence (opt2) from DENV-2__FM210244__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatcggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctccaaggaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatgcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12290 - RNA, 9876 nt, synthetic construct
  misc_feature 1..9876: note = derived and/or modified CDS sequence (opt2) from DENV-2__FM210234__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatcgccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12291 - RNA, 9876 nt, synthetic construct
  misc_feature 1..9876: note = derived and/or modified CDS sequence (opt2) from DENV-2__FM210213__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12292 - RNA, 9876 nt, synthetic construct
  misc_feature 1..9876: note = derived and/or modified CDS sequence (opt2) from DENV-2__FM210235__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgccgccactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgagtggtccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccgcgagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12293 - RNA, 9876 nt, synthetic construct
  misc_feature 1..9876: note = derived and/or modified CDS sequence (opt2) from DENV-2__FM210205__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctcaagaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12294 - RNA, 9876 nt, synthetic construct
  misc_feature 1..9876: note = derived and/or modified CDS sequence (opt2) from DENV-2__FM210206__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccctcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccatcgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12295 - RNA, 9876 nt, synthetic construct
  misc_feature 1..9876: note = derived and/or modified CDS sequence (opt2) from DENV-2__FM210246__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtccttcaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtcaagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12296 - RNA, 9876 nt, synthetic construct
  misc_feature 1..9876: note = derived and/or modified CDS sequence (opt2) from DENV-2__FM210207__SS-prME
  source 1..9876: mol_type = other RNA
tccgccggcatgatcatcatgctcatccccaccgtcatggccttccacctcaccacccgcaacggcgagccccacatgatcgtcggcatccaggagaagggcaagtccctcctcttcaagaccgaggacggcgtcaacatgtgcaccctcatggccatggacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagcacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacaagcaggagtccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccaggaggagggcatctgcggcatccgctccgtcacccgcctcgagaacctcatgtggaagcagatcacccccgagctcaaccacatcctcgccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcctacaaccagaccttcctcatcgacggccccgagaccgccgagtgccccaacaccaaccgcgcctggaactccctcgaggtcgaggactacggcttcggcgtcttcaccaccaacatctggctcaagctcaaggagaagcaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagaactgccactggcccaagtcccacaccctctggtccaacggcgtcctcgagtccgagatgatcatccccaagaacctcgccggccccgtctcccagcacaactaccgccccggctaccacacccagatcgccggcccctggcacctcggcaagctcgagatggacttcgacttctgcgacggcaccaccgtcatcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccaggtcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcgtcgtcatggtcggcgccaccatggccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccgtcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaagaccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccatctccatccccatcaccgccgccgcctggtacctctgggaggtcaagaagcagcgcgccggcgtcctctgggacgtcccctcccccccccccatgggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcatcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaagacccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccagcagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatgggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcctccccaccgtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagaacatccagcacctcaccgtcaccgaggaggtcgccgtccagaactggctcgcccgcgtcggccgcgagcgcctctcccgcatggccatctccggcgacgactgcgtcgtcaagcccctcgacgaccgcttcgccaacgccctcaccgccctcaacgacatgggcaagatccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatgcacgccaagcacgagtggatgaccaccgaggacatgctcaccgtctggaaccgcgtctggatccgcgagaacccctggatggaggacaagacccccgtcgagtcctgggaggagatcccctacctcggcaagcgcgaggaccagtggtgcggctccctcatcggcctcacctcccgcgccacctgggccaagaacatccaggccgccatcaaccaggtccgctccctcatcggcaacgaggagtacaccgactacatgccctccatgaagcgcttccgccgcgaggaggaggaggccggcgtcctctggtga

SEQ ID NO: 12297 - RNA, 9876 nt, synthetic construct
  misc_feature 1..9876: note = derived and/or modified CDS sequence (opt2) from DENV-2__FM210238__SS-prME
  source 1..9876: mol_type = other RNA
accgccggcatgatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacgaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12298 - RNA, 9876 nt, synthetic construct
  misc_feature 1..9876: note = derived and/or modified CDS sequence (opt2) from DENV-2__FM210224__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgccaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12299 - RNA, 9876 nt, synthetic construct
  misc_feature 1..9876: note = derived and/or modified CDS sequence (opt2) from DENV-2__FM210225__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatcgacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcatcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12300 - RNA, 9876 nt, synthetic construct
  misc_feature 1..9876: note = derived and/or modified CDS sequence (opt2) from DENV-2__FM210226__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccgccatgaccgacgacatcggcatcggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccaccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggcacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccgtccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12301 - RNA, 9876 nt, synthetic construct
  misc_feature 1..9876: note = derived and/or modified CDS sequence (opt2) from DENV-2__FM210227__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccgtcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccaccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatgatcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaacttcggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccgtcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatgggcggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgacctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12302 - RNA, 9876 nt, synthetic construct
  misc_feature 1..9876: note = derived and/or modified CDS sequence (opt2) from DENV-2__FM210204__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccgtcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgccatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcctacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggcctcgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccgtcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccccccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctccaagggctggaacgactggacccaggtccccttctgctcccaccacttccacgacctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12303 - RNA, 9876 nt, synthetic construct
  misc_feature 1..9876: note = derived and/or modified CDS sequence (opt2) from DENV-2__FM210230__SS-prME
  source 1..9876: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacccacttccagcgcgccctcatcttcatcctcctcgccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcccccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcatcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctactacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcaccgtctccttcgtcaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccatgctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccaccgacgtcaagtgggaggaccaggccgagatctccggctcctcccccatcctctccatcaccatcgccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcgccacccaggagcccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcgtcaccgtcatcgacctcgaccccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaaggacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctctccctcgtcgagaactggctcaacaacgacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatctgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaagggcggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcgtcttcaagtccatccagcgcctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcaccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12304 - RNA, 9876 nt, synthetic construct
  misc_feature 1..9876: note = derived and/or modified CDS sequence (opt2) from DENV-2__KC762665__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcgcccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12305 - RNA, 9876 nt, synthetic construct
  misc_feature 1..9876: note = derived and/or modified CDS sequence (opt2) from DENV-2__KC762669__SS-prME
  source 1..9876: mol_type = other RNA
accgccggcatcatcatcatggtcatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcatcatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagctcgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12306 - RNA, 9876 nt, synthetic construct
  misc_feature 1..9876: note = derived and/or modified CDS sequence (opt2) from DENV-2__KC762658__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgcccccggcgagcaccgccgcgagaagcgctccgtcgccctcgtcccccacgtcggcatgggcctcgagacccgcaccgagacctggatgtcctccgagggcgccggcaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagctccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgagaagtacaccgactacatgccctccatgaagcgcttccgccgcgaggaggaggaggccggcgtcctctggtga

SEQ ID NO: 12307 - RNA, 9876 nt, synthetic construct
  misc_feature 1..9876: note = derived and/or modified CDS sequence (opt2) from DENV-2__KC762660__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcatcgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccaggagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12308 - RNA, 9876 nt, synthetic construct
  misc_feature 1..9876: note = derived and/or modified CDS sequence (opt2) from DENV-2__KC762676__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctactgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtctccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctaccgcacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12309 - RNA, 9876 nt, synthetic construct
  misc_feature 1..9876: note = derived and/or modified CDS sequence (opt2) from DENV-2__KC762662__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtcaccgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12310 - RNA, 9876 nt, synthetic construct
  misc_feature 1..9876: note = derived and/or modified CDS sequence (opt2) from DENV-2__KC762661__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccagacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12311 - RNA, 9876 nt, synthetic construct
  misc_feature 1..9876: note = derived and/or modified CDS sequence (opt2) from DENV-2__KC762655__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccgtctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaacaaggccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccaccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgctccctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcatcgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggcccgcaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12312 - RNA, 9876 nt, synthetic construct
  misc_feature 1..9876: note = derived and/or modified CDS sequence (opt2) from DENV-2__KC762656__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcgccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcaccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccagtggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcgtctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12313 - RNA, 9876 nt, synthetic construct
  misc_feature 1..9876: note = derived and/or modified CDS sequence (opt2) from DENV-2__KC762673__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacccccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctactgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatcaaggccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctaccgcacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12314 - RNA, 9876 nt, synthetic construct
  misc_feature 1..9876: note = derived and/or modified CDS sequence (opt2) from DENV-2__KC762663__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtcaccgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12315 - RNA, 9876 nt, synthetic construct
  misc_feature 1..9876: note = derived and/or modified CDS sequence (opt2) from DENV-2__KC762675__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctactgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatccagcaggagcacgagacctcctggcactacgaccaggaccacccctaccgcacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaaggaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12316 - RNA, 9876 nt, synthetic construct
  misc_feature 1..9876: note = derived and/or modified CDS sequence (opt2) from DENV-2__KC762671__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccatgaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12317 - RNA, 9876 nt, synthetic construct
  misc_feature 1..9876: note = derived and/or modified CDS sequence (opt2) from DENV-2__KC762664__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcaccgacctcgagaagcgccacggcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcaaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtcaccgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcggctcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12318 - RNA, 9876 nt, synthetic construct
  misc_feature 1..9876: note = derived and/or modified CDS sequence (opt2) from DENV-2__KC762674__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctactgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12319 - RNA, 9876 nt, synthetic construct
  misc_feature 1..9876: note = derived and/or modified CDS sequence (opt2) from DENV-2__KC762672__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctgggagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacgccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcgcccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccatgaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12320 - RNA, 9876 nt, synthetic construct
  misc_feature 1..9876: note = derived and/or modified CDS sequence (opt2) from DENV-2__KC762667__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcgtcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcgcgagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12321 - RNA, 9876 nt, synthetic construct
  misc_feature 1..9876: note = derived and/or modified CDS sequence (opt2) from DENV-2__KC762659__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatggagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgccgcctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12322 - RNA, 9876 nt, synthetic construct
  misc_feature 1..9876: note = derived and/or modified CDS sequence (opt2) from DENV-2__KC762657__SS-prME
  source 1..9876: mol_type = other RNA
accgccggcatcatcatcatgatgatccccaccgtcatggtcttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatggagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgccgcctcacctccaaggagctcatgatgaccaccatcggcatcgtcctcctctcccagtccaccatccccgagaccatcctcgagctcaccgacgccctcgccctcggcatgatggtcctcaagatcgtccgcaagatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagtccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatcgaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12323 - RNA, 9876 nt, synthetic construct
  misc_feature 1..9876: note = derived and/or modified CDS sequence (opt2) from DENV-2__KC762666__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcgcgagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12324 - RNA, 9876 nt, synthetic construct
  misc_feature 1..9876: note = derived and/or modified CDS sequence (opt2) from DENV-2__KC762677__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctactgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccatgaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctaccgcacctgggcctaccacggctcctacgagaacaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcaaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12325 - RNA, 9876 nt, synthetic construct
  misc_feature 1..9876: note = derived and/or modified CDS sequence (opt2) from DENV-2__KC762668__SS-prME
  source 1..9876: mol_type = other RNA
accgccggcatcatcatcatggtcatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcatcatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagctcgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagcgcctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12326 - RNA, 9876 nt, synthetic construct
  misc_feature 1..9876: note = derived and/or modified CDS sequence (opt2) from DENV-2__KC762678__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcatcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacgccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatcggcgtcacctacctcgccctcctcgccgccttcaaggtccgccccaccttcgccgccggcctcctcctccgcaagctcacctccaaggagctcatgatgaccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagacctccaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggtccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcgtcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcaccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctctccccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtcaccgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12327 - RNA, 9876 nt, synthetic construct
  misc_feature 1..9876: note = derived and/or modified CDS sequence (opt2) from DENV-2__KC762679__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccatgaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12328 - RNA, 9876 nt, synthetic construct
  misc_feature 1..9876: note = derived and/or modified CDS sequence (opt2) from DENV-2__KC762680__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgctacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggactcccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccaggccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacttcgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccatgaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcaagggcaacgaggagtacaccgactacatgccctccatgaagcgcttccgccgcgaggagggcgaggccggcgtcctctggtga

SEQ ID NO: 12329 - RNA, 9876 nt, synthetic construct
  misc_feature 1..9876: note = derived and/or modified CDS sequence (opt2) from DENV-2__JQ955624__SS-prME
  source 1..9876: mol_type = other RNA
accgccggcgtcatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcgccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcgtccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccaccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccgtcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcatcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagtccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgagctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcttcggctccatcgccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcatggacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagatgggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagtccatccagcacctcaccaccaccgaggaggtcgccgtccaggactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 12330 - RNA, 9876 nt, synthetic construct
  misc_feature 1..9876: note = derived and/or modified CDS sequence (opt2) from DENV-2__KJ918750__SS-prME
  source 1..9876: mol_type = other RNA
accgccggcatgatcatcatgctcatccccaccgtcatggccttccacctcaccacccgcaacggcgagccccacatgatcgtctcccgccaggagaagggcaagtccctcctcttcaagaccaaggacggcaccaacatgtgcaccctcatggccatggacctcggcgagctctgcgaggacaccatcacctacaagtgccccttcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgcccagcgcatcgagatctggatcctccgccaccccggcttcaccatcatggccgccatcctcgcctacaccatcggcaccacccacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgactcccgctgccccacccagggcgagcccaccctcaacgaggagcaggacaagcgcttcgtctgcaagcactccatggtcgaccgcggctggggcaacggctgcggcctcttcggcaagggcggcatcgtcacctgcgccatgttcacctgcaagaagatcatgaagggcaagatcgtccagcccgagaacctcgagtacaccgtcgtcatcaccccccactccggcgaggagcacgccgtcggcaacgacaccggcaagcacggcaaggaggtcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgctcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcaccggcgtcatcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcgtcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggtcggcaagcgctccctccgcccccagcccaccgagctccgctactcctggaagacctggggcaaggccaagatgctctccaccgagctccacaaccagaccttcctcatcgacggccccgagaccgccgagtgccccaacaccaaccgcgcctggaactccctcgaggtcgaggactacggcttcggcgtcttcaccaccaacatctggctccgcctccgcgagaagcaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccgacggcgtcctcgagtccgagatggtcatccccaagaacttcgccggccccgtctcccagcacaacaaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtctcctccctcgtcaccgccggccacggccagatcgacaacttctccctcggcatcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtcctccatccccgagaccatcctcgagctcaccgacgccctcgccctcggcatgatggtcctcaagatggtccgcaacatggagaagtaccagctcgccgtcaccatcatggccatcctctgcgtccccaacgccgtcatcctccagaacgcctggaaggtctcctgcaccatcctcgccctcgtctccgtctcccccctcttcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggacgaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcgcctacgtctccgccatcgcccagaccgagaagtccatcgaggacaaccccgagatcgaggacgacatcttccgcaagcgccgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagcgcgtcatccagctctcccgcaagaccttcgactccgagtacgtcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcacccgcaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggcaaggcctacaaccacgccctctccgagctccccgagaccctcgagaccctcctcctcctcaccctcctcgccaccgtcaccggcggcatcttcctcttcctcatgtccggccgcggcatcggcaagatgaccctcggcatgtgctgcatcatcaccgcctccatcctcctctggtgcgcccagatccagccccactggatcgccgcctccatcatcctcgagttcttcctcatcgtcctcctcatccccgagcccgagaagcagcgcaccccccaggacaaccagctcacctacgtcatcatcgccatcctcaccgtcgtcgccgccaccatggccaacgagatgggcttcctcgagaagaccaagaaggacctcggcctcggcaacatcgtcacccagcagcccgagtccaacatcctcgacatcgacctccgccccgcctccgcctggaccctctacgccgtcgccaccaccttcatcacccccatgctccgccactccatcgagaactcctccgtcaacatgtccctcaccgccatcgccaaccaggccaccgtcctcatgggcctcggcaagggctggcccctctccaagatggacatcggcgtccccctcctcgccatcggctgctgctcccaggtcaaccccatcaccctcaccgccgccctcttcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatcatgcgcaccacctgggccctctgcgaggccctcaccctcgccaccggccccgtctccaccctctgggagggcaaccccggccgcttctggaacaccaccatcgccgtctccatggccaacatcttccgcggctcctacctcgccggcgccggcctcctcttctgcatcatgaacaacaccacccgcctccgccgcggcaccggccacctccgcaagaccctcggcgacaagtgcaagtcccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcatcccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcaccaagaaggtccgctccaacgccgccctcggcgccatcttcaccgacgagaacaagtggaagtccgcccgcgaggccgtcgaggacggccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccatcgaggacctcaagaacgaggagatgatcaccaaccacatggccggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccaggactggctcgcccgcgtcggccgcgagcgcctctcccgcatggccatctccggcgacgactgcgtcgtcaagcccctcgacgaccgcttcgcccgcgccctcaccgccctcaacgacatgggcaaggtccgcaaggacatccagcagtgggagccctcccgcggctggaacgactggacccaggtccccttctgctcccaccacttccacgagctcatcatgaaggacggccgcaccctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcctcccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12331 - RNA, 9876 nt, synthetic construct
  misc_feature 1..9876: note = derived and/or modified CDS sequence (opt2) from DENV-2__KU517845__SS-prME
  source 1..9876: mol_type = other RNA
accgccggcatcatcatcatgatgatccccaccgtcatcgccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccgcctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcaccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatggccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgccttctgcgactccaagctcatgtccgccgccatcaaggacaaccgcgccatccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgtcctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccgtctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccaaccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagatcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcacctcccacatgaagggcgagcaccgcaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12332 - RNA, 9876 nt, synthetic construct
  misc_feature 1..9876: note = derived and/or modified CDS sequence (opt2) from DENV-2__KU517847__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaaggtcctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgagaactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccgccctcgccgtcgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccttcctcaagaacgacatccccatgaccggccccctcgtcgccggcggcctcctcaccgtctgctacgtcctcaccggccgctccgccgacctcgagctcgagcgcgccgccgacatccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgcctccatccccatcaccgccgccgcctggtacctctgggaggtcaagaagcagcgcgccggcgtcctctgggacgtcccctcccccccccccgtcggccgcgccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcgtcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgccgctacggcggcgccctcgtccgcaaccccccctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgaggtccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgccaccgaggagatcgccgtcaagaactggctcgtccgcgtcggccgcgagcgcctctcccgcatggccatctccggcgacgactgcgtcgtcaagcccttcgacgaccgcttcgccaacgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12333 - RNA, 9876 nt, synthetic construct
  misc_feature 1..9876: note = derived and/or modified CDS sequence (opt2) from DENV-2__JQ955623__SS-prME
  source 1..9876: mol_type = other RNA
accgccggcatgatcatcatgctcatccccaccgccatggccttccacctcaccacccgcaacggcgagccccacatgatcgtctcccgccaggagaagggcaagtccctcctcttcaagaccgaggacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacccacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcgtcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcatcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagccccacaaccagaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccgtcctcctcgtcgccgtctccttcatgaccctcatcaccggcaacatgtccttccgcgacctcggccgcgtcatggtcatggtcggcgccgccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcaccaacaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtccgcaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccacccagcagctcgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacaccggcgagaccctcggcgagaagtggaagaaccgcctcaactccctcggcaagtccgagttccagatctacaagcgctccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacgacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcaacaaggagcgcaacctccacctcgagggcaagtgcgagacctgcgtctacaacatgatgggcaagcgcgagaagaagatcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgaggtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatgggcgcccagctcatccgccagatggagggcgagggcgtcttcaagggcatccagcacctcaccgccaccgaggagaccgccgtccacgactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgcccgccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctccgaggagtacaccgactacatgccctccatgaagcgcttccgccgcgaggaggaggaggccggcgtcctctggtga

SEQ ID NO: 12334 - RNA, 9876 nt, synthetic construct
  misc_feature 1..9876: note = derived and/or modified CDS sequence (opt2) from DENV-2__KR779782__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgagcagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12335 - RNA, 9876 nt, synthetic construct
  misc_feature 1..9876: note = derived and/or modified CDS sequence (opt2) from DENV-2__KM279608__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgtcaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacctccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggacaaccccgtcaacatcgaggccgagccccccttcggcgactcctacatcatcatcggcgtcgagcccggccagctcaagctctcctggtacaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggcgcaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctcgagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcaagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12336 - RNA, 9876 nt, synthetic construct
  misc_feature 1..9876: note = derived and/or modified CDS sequence (opt2) from DENV-2__KM279605__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggacaaccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctcgagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12337 - RNA, 9876 nt, synthetic construct
  misc_feature 1..9876: note = derived and/or modified CDS sequence (opt2) from DENV-2__KM279609__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcacctcgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12338 - RNA, 9876 nt, synthetic construct
  misc_feature 1..9876: note = derived and/or modified CDS sequence (opt2) from DENV-2__KM279607__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacctccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggacaaccccgtcaacatcgaggccgagccccccttcggcgactcctacatcatcatcggcgtcgagcccggccagctcaagctctcctggtacaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctcgagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12339 - RNA, 9876 nt, synthetic construct
  misc_feature 1..9876: note = derived and/or modified CDS sequence (opt2) from DENV-2__KM279606__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggacaaccccgtcaacatcgaggccgagccccccttcggcgactcctacatcatcatcggcgtcgagcccggccagctcaagctctcctggtacaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctcgagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgccgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12340 - RNA, 9876 nt, synthetic construct
  misc_feature 1..9876: note = derived and/or modified CDS sequence (opt2) from DENV-2__JN851113__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12341 - RNA, 9876 nt, synthetic construct
  misc_feature 1..9876: note = derived and/or modified CDS sequence (opt2) from DENV-2__GU370050__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatcctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacaagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12342 - RNA, 9876 nt, synthetic construct
  misc_feature 1..9876: note = derived and/or modified CDS sequence (opt2) from DENV-2__JN851129__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctctccgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacctctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagtccttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacatcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagaccctcgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12343 - RNA, 9876 nt, synthetic construct
  misc_feature 1..9876: note = derived and/or modified CDS sequence (opt2) from DENV-2__JN851128__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaaccaccccgccaccctccgcaagtactgcatcgaggccaagctcaccaacaccaccaccgcctcccgctgccccacccagggcgagccctccctctccgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacctctggctcaagctcaaggagcgccaggacgtcttctgcgactccaagctcatgtccgccgccatcaaggacaaccgcgccgtccacgccgacatgggctactggatcgagtccgccatcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatgatcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacatcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagaccctcgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12344 - RNA, 9876 nt, synthetic construct
  misc_feature 1..9876: note = derived and/or modified CDS sequence (opt2) from DENV-2__JN851130__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgctactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggccctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12345 - RNA, 9876 nt, synthetic construct
  misc_feature 1..9876: note = derived and/or modified CDS sequence (opt2) from DENV-2__JN851125__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagatgaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaaggtcgtccgcaacatggagaagtaccagctcgccgtcaccatcatggccatcctctgcgtccccaacgccgtcatcctccagaacgcctggaaggtctcctgcaccaccctcgccgtcgtctccgtcttccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagtccgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctcctccaccacccagcagcacgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12346 - RNA, 9876 nt, synthetic construct
  misc_feature 1..9876: note = derived and/or modified CDS sequence (opt2) from DENV-2__JN851123__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgagatcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcatcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccatcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12347 - RNA, 9876 nt, synthetic construct
  misc_feature 1..9876: note = derived and/or modified CDS sequence (opt2) from DENV-2__JN851118__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactggatccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12348 - RNA, 9876 nt, synthetic construct
  misc_feature 1..9876: note = derived and/or modified CDS sequence (opt2) from DENV-2__JN851124__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcatgcgccaccccggcttcaccgtcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagatgaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtctcctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaaggtcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagtccgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctcctccaccacccagcagcacgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctctccctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggtcacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgccaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12349 - RNA, 9876 nt, synthetic construct
  misc_feature 1..9876: note = derived and/or modified CDS sequence (opt2) from DENV-2__JN851114__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12350 - RNA, 9876 nt, synthetic construct
  misc_feature 1..9876: note = derived and/or modified CDS sequence (opt2) from DENV-2__JN851126__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgagatcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacaccatcctcctcgtcgccgtctccttcgtcaccctcatcaccggcaacatgtccttccgcgacctcggccgcgtcgtcgtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccgccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagaaggagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcgtcaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagacctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggagaccctccagcgcaagcacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12351 - RNA, 9876 nt, synthetic construct
  misc_feature 1..9876: note = derived and/or modified CDS sequence (opt2) from DENV-2__JN851121__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccaaccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12352 - RNA, 9876 nt, synthetic construct
  misc_feature 1..9876: note = derived and/or modified CDS sequence (opt2) from DENV-2__JN851115__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggctcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagtccgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggctacgaggagtacaccgactacatgccctccatgaagcgcttccgccgcgaggaggaggaggccggcgtcctctggtga

SEQ ID NO: 12353 - RNA, 9876 nt, synthetic construct
  misc_feature 1..9876: note = derived and/or modified CDS sequence (opt2) from DENV-2__JN851127__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctcaagcagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctctccgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgagatcaagctcaccatcatgaccggcgacatcaagggcatcatgcaggccggcaagcgctccctccgcccccagcccatcgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgtcatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccgccagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcatcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagcgcaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgtccacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccatcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12354 - RNA, 9876 nt, synthetic construct
  misc_feature 1..9876: note = derived and/or modified CDS sequence (opt2) from DENV-2__JN851120__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccgtcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgcatcgaggaggaggaggccggcgtcctctggtga

SEQ ID NO: 12355 - RNA, 9876 nt, synthetic construct
  misc_feature 1..9876: note = derived and/or modified CDS sequence (opt2) from DENV-2__JN851131__SS-prME
  source 1..9876: mol_type = other RNA
accgccggcgtcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatcgacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaaggaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggaggtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgcccctccaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgtcgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtggatcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccgtcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcgccatccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagaagcccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcaacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12356 - RNA, 9876 nt, synthetic construct
  misc_feature 1..9876: note = derived and/or modified CDS sequence (opt2) from DENV-2__JN851122__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaagaccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcacccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacatcggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12357 - RNA, 9876 nt, synthetic construct
  misc_feature 1..9876: note = derived and/or modified CDS sequence (opt2) from DENV-2__JN851116__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccatcctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatgaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcaagaactggctcatccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12358 - RNA, 9876 nt, synthetic construct
  misc_feature 1..9876: note = derived and/or modified CDS sequence (opt2) from DENV-2__GU370051__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctggatcctccgccaccccggcttcaccatcatggccgccatcctcgcctacaccatcggcaccacctacttccagcgcgtcctcatcttcatcctcctcaccgccgtcaccccctccatggccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcgtcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaaggtcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctcaccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagtccatcctcgagctcaccgacgccctcgccctcggcatgatggtcctcaagatcgtccgcaacatggagaagtaccagctcgccgtcaccatcatggccatcctctgcgtccccaacgccgtcatcctcgagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgacatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgacaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggccaagaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaccccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcggcaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaaggaggagatcgccgtcgagaactggctcatgcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12359 - RNA, 9876 nt, synthetic construct
  misc_feature 1..9876: note = derived and/or modified CDS sequence (opt2) from DENV-2__EU359009__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccttcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacaccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12360 - RNA, 9876 nt, synthetic construct
  misc_feature 1..9876: note = derived and/or modified CDS sequence (opt2) from DENV-2__KC131142__SS-prME
  source 1..9876: mol_type = other RNA
accgccggcatcatcatcatggtcatccccaccgtcatggccttccacctcaccacccgcaacggcgagccccacatgatcgtctcccgccaggagaagggcaagtccctcctcttcaagaccgagaacggcctcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccatcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaaggcctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcatctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaacctcgagatcgaggacgacatcttccgcaagaagcgcctcaccgtcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgacaccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagacccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtcaagctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcggcgccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgtccacaagaagctcgccgaggccatcttccgcctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcacctcaccgtcaccgaggagatcgccgtcaagaactggctcgtccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12361 - RNA, 9876 nt, synthetic construct
  misc_feature 1..9876: note = derived and/or modified CDS sequence (opt2) from DENV-2__AY858035__SS-prME
  source 1..9876: mol_type = other RNA
accgccggcatcatcatcatgatgatccccaccgtcatggccttccacctcaccacccgcaacggcgagccccacatgatcgtctcccgccaggagaagggcaagtccctcctcttcaagaccgagaacggcgtcaacatgtgcaccctcatggccatggacctcggcgagctctgcgaggacaccatcacctacaactgccccctcctccgccagaacgagcccgaggacatcgactgctggtgcaactccacctccacctgggtcacctacggcacctgcaccgccaccggcgagcaccgccgcgagaagcgctccgtcgccctcgtcccccacgtcggcatgggcctcgagacccgcaccgagacctggatgtcctccgagggcgcctggaagcacgcccagcgcatcgagacctgggtcctccgccaccccggcttcaccatcatggccgccatcctcgcctacaccatcggcaccacctacttccagcgcgtcctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcaccccgccaccctccgcaagtactgcatcgaggccaagctcaccaacaccaccaccgcctcccgctgccccacccagggcgagccctccctcaacgaggagcaggacaagcgcttcgtctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagaacgccgtcggcaacgacaccggcaagcacggcaaggagatcaaggtcaccccccagtcctccatcaccgaggccgagctcaccggctacggcaccgtcaccatggagtgctccccccgcaccggcctcgacttcaacgagatggtcctcctccagatggagaacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaaggtcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctctcctggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcgtcatcacctggatcggcatgaactcccgctccacctccctctccgtctccctcgtcctcgtcggcgtcgtcaccctctacctcggcgtcatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagctccacaaccacaccttcctcatcgacggccccgagaccgccgagtgccccaacaccaaccgcgcctggaactccctcgaggtcgaggactacggcttcggcgtcttcaccaccaacatctggctcaagctcaaggagcgccaggacgtcttctgcgactccaagctcatgtccgccgccatcaaggacaaccgcgccgtccacgccgacatgggctactggatcgagtccgccctcaacgacacctggaagatcgagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggccgcctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatgaccaccatcggcatcgtcctcctctcccagtccaccatccccgagaccatcctcgagctcaccgacgccctcgccctcggcatgatggtcctcaagatcgtccgcaacatggagaagtaccagctcgccgtcaccatcatggccatcctctgcgtccccaacgccgtcatcctccagaacgcctggaaggtctcctgcaccaccctcgccgtcgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtccgctgggaggagcaggccgagatctccggctcctcccccatcctctccatcaccatctccgaggacggctccatgtccatcaagaacgaggaggaggagcagaccctcaccatcctcatccgcaccggcctcctcgtcgtctccggcctcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagaagggcatcctcggctactcccagatcggcgccggcgtctacaaggagggcaccttccacaccatgtggcacgtcacccgcggcgccgtcctcatgcacaagggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgacaagaagggcaaggtcgtcggcctctacggcaacggcgtcgtcacccgctccggcacctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccatccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacatcaagacccgcaccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgccgctggtgcttcgacggcgtcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacttcggcctcggctccatcaccacccagcagcccgagtccaacatcctcgacatcgacctccgccccgcctccgcctggaccctctacgccgtcgccaccaccttcatcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgaccccatcccctacgaccccaagttcgagaagcagctcggccaggtcatgctcctcgtcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccgccaacacccgccgcggcaccggcaacaccggcgagaccctcggcgagaagtggaagaaccgcctcaacaccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacctcgtcacccccgagggcaaggtcgtcgacctcggctgcggccgcggcggctggtcctactactgcggcggcctcaagaacgtcaaggaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccgtcgaggccggccgcaccctccgcgtcctcaacctcgtcgagaactggctcaacaacaacacccagttctgcatcaaggtcctcaacccctacatgccctccgtcatcgagaagatggaggccctccagcgcaagtacggcggcgccctcgtccgcaaccccctctcccgcaactccacccacgagatgtactgggtctccaacgcctccggcaacatcgtctcctccgtcaacatgatctcccgcatgctcatcaaccgcttcaccatgcgccacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcatccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaagaagaagacccgccgcatgtgcacccgcgaggagttcacccgcaaggtccgctccaacgccgccctcggcgccatcttcaccgacgagaacaagtggaagtccgcccgcgaggccgtcgaggactccggcttctgggagctcgtcgacaaggagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccacaagctcggctacatcctccgcgacgtctccaagaaggagggcggcgccatgtacgccgacgacaccgccggctgggacacccgcatcaccctcgaggacctcaagaacgaggagatggtcaccaaccacatggagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcgtcacctacggcctcaacaccttcaccaacatggaggcccagctcatccgccagatggagggcgagggcgtcttcaagtccatccagcagctcaccgtcaccgaggagatcgccgtcaagaactggctcgagcgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcatcatgaaggacggccgcgtcctcgtcgtcccctgccgcaaccaggacgagctcatcggccgcgcccgcatctcccagggcgccggctggtccctccgcgagaccgcctgcctcggcaagtcctacgcccagatgtggtccctcatgtacttccaccgccgcgacctccgcctcgccgccaacgccatctgctccgccgtcccctcccactgggtccccacctcccgcaccacctggtccatccacgccacccacgagtggatgaccaccgaggacatgctcaccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctggtga

SEQ ID NO: 12362 - RNA, 9873 nt, synthetic construct
  misc_feature 1..9873: note = derived and/or modified CDS sequence (opt2) from DENV-2__JX567951__SS-prME
  source 1..9873: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaagatcgtccagcccgagaacctcgagtacaccatcgtcatcaccccccactccggcgaggagcacgccgtcggcaacgacaccggcaagcacggcaaggagatcaagatcaccccccagtcctccaccaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctctccgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcttcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgaggtcggcaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgcaaggaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctgg

SEQ ID NO: 12363 - RNA, 9873 nt, synthetic construct
  misc_feature 1..9873: note = derived and/or modified CDS sequence (opt2) from DENV-2__JX567950__SS-prME
  source 1..9873: mol_type = other RNA
accgccggcgtcatcgtcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcaccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggacaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcaccgacctcgagaagcgccacgtcctcggccgcctcatcaccgtcaaccccatcgtcaccgagaaggactcccccgtcaacatcgaggccgagccccccttcggcgactcctacatcatcgtcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcatcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccctctccttcgtcaccctcatcaccggcaacatgtccttccgcgacctcggccgcgtcatggtcatggtcggcgccaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccctccccgagaccatcctcgagctcaccgacgccctcgccctcggcatgatggccctcaagatcgtccgcaacatggagaagtaccagctcgccgtcaccatcatggccatctcctgcgtccccaacgccgtcatcctccagaacgcctggaaggtctcctgcaccatcctcgccgccgtctccgtctcccccctcctcctcacctcctcccagcagaaggccgactggatccccctcgccctcaccatcaagggcctcaaccccaccgccatcttcctcaccaccctctcccgcacctccaagaagcgctcctggcccctcaacgaggccatcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccgtcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcatcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttctccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttcaaggccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctacaaggtcgccgccgagggcatcaactacgccgaccgcaagtggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcaacgccctcgacaacctcgccgtcctccacaccgccgaggtcggcggcaaggcctacacccacgccctcaacgagctccccgagaccctcgagaccctcctcctcctcaccctcctcgccgccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaagtacctcggcctcggctccatcaccacccaggagtccgagtccaacatcctcgacatcgacctccgccccgcctccgcctggaccctctacgccgtcgccaccaccttcgtcacccccatgctccgccactccatcgtcaactcctccgtcaacgtcaccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacgtcggcgagaccctcggcgagaagtggaagtcccgcctcaacgccctcggcaagaacgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgccgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgaagatcaccgccgagtggctctggaaggagctcggcaaggagaagaccccccgcatgtgcacccgcgaggagttcacccgcaaggtccgctccaacgccgccctcggcgccgtcttcaccgacgagaacaagtggaagtccgcccgcgaggccgtcgaggacggccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcgagaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgccaccgaggagatcgccgtccagaactggctcgcccgcgtcggccgcgagcgcctctcccgcatggccatctccggcgacgactgcgtcgtcaagcccatcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggagatcccctacctcggcaagcgcgaggaccagtggtgcggctccctcatcggcctcacctcccgcgccacctgggccaagaacatccagaccgccatcaaccaggtccgctccctcatcggcaacgagggctacaccgactacatgccctccatgaagcgcttccgccgcgaggaggaggaggccggcgtcctctgg

SEQ ID NO: 12364 - RNA, 9873 nt, synthetic construct
  misc_feature 1..9873: note = derived and/or modified CDS sequence (opt2) from DENV-2__HQ012538__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg

SEQ ID NO: 12365 - RNA, 9873 nt, synthetic construct
  misc_feature 1..9873: note = derived and/or modified CDS sequence (opt2) from DENV-2__HQ012533__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg

SEQ ID NO: 12366 - RNA, 9873 nt, synthetic construct
  misc_feature 1..9873: note = derived and/or modified CDS sequence (opt2) from DENV-2__HQ012534__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatgctcggcgtccccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg

SEQ ID NO: 12367 - RNA, 9873 nt, synthetic construct
  misc_feature 1..9873: note = derived and/or modified CDS sequence (opt2) from DENV-2__HQ012535__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcgaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcatggacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccgagaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacgacacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttccgcgacctcggccgcgtcatggtcatggtcggcgtcaccatgaccgacgacatcggcatgggcgtcacctacctcgccctcctcgccgccttcaaggtccgccccaccttcgccgccggcctcctcctccgcaagctcacctccaaggagctcatgatggccaccatcggcatcgccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcgagaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcatcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgccgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatggaggacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg

SEQ ID NO: 12368 - RNA, 9873 nt, synthetic construct
  misc_feature 1..9873: note = derived and/or modified CDS sequence (opt2) from DENV-2__HQ012536__SS-prME
  source 1..9873: mol_type = other RNA
accgccggcgtcatcatcatgctcatccccaccgccatggccttccacctcaccacccgcaacggcgagccccacatgatcgtcggccgccaggagaagggcaagtccctcctcttcaagaccgaggacggcgtcaacatgtgcaccctcatggccatcgacctcggcgagctctgcgaggacaccatcacctacaagtgccccctcctccgccagaacgagcccgaggacatcgactgctggtgcaactccacctccacctgggtcacctacggcacctgcaccaccaccggcgagcaccgccgcgagaagcgctccgtcgccctcgtcccccacgtcggcatgggcctcgagacccgcaccgagacctggatgtcctccgagggcgcctggaagcacgtccagcgcatcgagacctggatcctccgccaccccggcttcgccatcatggccgccatcctcgcctacaccatcggcaccacccacttccagcgcgccctcatcttcatcctcctcaccgccgtcgccccctccatgaccatgcgctgcatcggcatctccaaccgcgacttcgtcgagggcgtctccggcggctcctgggtcgacatcgtcctcgagcacggctcctgcgtcaccaccatggccaagaacaagcccaccctcgacttcgagctcatcaagaccgaggccaagcagcccgccaccctccgcaagtactgcatcgaggccaagctcaccaacaccaccaccgagtcccgctgccccacccagggcgagccctccctcaacgaggagcaggacaagcgcttcatctgcaagcactccatggtcgaccgcggctggggcaacggctgcggcctcttcggcaagggcggcatcgtcacctgcgccatgttcacctgcaagaagaacatggagggcaaggtcgtcctccccgagaacctcgagtacaccatcgtcatcaccccccactccggcgaggagcacgccgtcggcaacgacaccggcaagcacggcaaggagatcaagatcaccccccagtcctccatcaccgaggccgagctcaccggctacggcaccgtcaccatggagtgctccccccgcaccggcctcgacttcaacgagatggtcctcctccagatggaggagaaggcctggctcgtccaccgccagtggttcctcgacctccccctcccctggctccccggcgccgacacccagggctccaactggatccagaaggagaccctcgtcaccttcaagaacccccacgccaagaagcaggacgtcgtcgtcctcggctcccaggagggcgccatgcacaccgccctcaccggcgccaccgagatccagatgtcctccggcaacctcctcttcaccggccacctcaagtgccgcctccgcctcgacaagctccagctcaagggcatgtcctactccatgtgcaccggcaagttcaagatcgtcaaggagatcgccgagacccagcacggcaccatcgtcatccgcgtccagtacgagggcgacggctccccctgcaagatccccttcgagatcatggacctcgagaagcgccacgtcctcggccgcctcatcaccgtcaaccccatcgtcaccggcaaggactcccccgtcaacatcgaggccgagccccccttcggcgactcctacatcatcatcggcgtcgagcccggccagctcaagctcaactggttcaagaagggctcctccatcggccagatgttcgagaccaccatgcgcggcgccaagcgcatggccatcctcggcgacaccgcctgggacttcggctccctcggcggcgtcttcacctccatcggcaaggccctccaccaggtcttcggcgccatctacggcgccgccttctccggcgtctcctggaccatgaagatcctcatcggcgtcatcatcacctggatcggcatgaactcccgctccacctccctctccgtctccctcgtcctcgtcggcgtcgtcaccctctacctcggcgccatggtccaggccgactccggctgcgtcgtctcctggaagaacaaggagctcaagtgcggctccggcatcttcatcaccgacaacgtccacacctggaccgagcagtacaagttccagcccgagtccccctccaagctcgcctccgccatccagaaggcccacgaggagggcatctgcggcatccgctccgtcacccgcctcgagaacctcatgtggaagcagatcacccccgagctcaaccacatcctctccgagaacgaggtcaagctcaccatcatgaccggcgacatcaagggcatcatgcaggccggcaagcgctccctccgcccccagcccaccgagctcaagtactcctggaagacctggggcaaggccaagatgctctccaccgagtcccacaaccagaccttcctcatcgacggccccgagaccgccgagtgccccaacaccaaccgcgcctggaactccctcgaggtcgaggactacggcttcggcgtcttcaccaccaacatctggctcaagctccgcgagaagcaggacgtcttctgcgactccaagctcatgtccgccgccatcaaggacaaccgcgccgtccacgccgacatgggctactggatcgagtccgccctcaacggcacctggaagatggagaaggcctccttcatcgaggtcaagtcctgccactggcccaagtcccacaccctctggtccaacggcgtcctcgagtccgagatgatcatccccaagaacttcgccggccccgtctcccagcacaactaccgccccggctaccacacccagaccgccggcccctggcacctcggcaagctcgagatggacttcgacttctgcgagggcaccaccgtcgtcgtcaccgaggactgcggcaaccgcggcccctccctccgcaccaccaccgcctccggcaagctcatcaccgagtggtgctgccgctcctgcaccctcccccccctccgctaccgcggcgaggacggctgctggtacggcatggagatccgccccctcaaggagaaggaggagaacctcgtcaactccctcgtcaccgccggccacggccagatcgacaacttctccctcggcgtcctcggcatggccctcttcctcgaggagatgctccgcacccgcgtcggcaccaagcacgccatcctcctcgtcgccgtctccttcgtcaccctcatcaccggcaacatgtccttcaaggacctcggccgcgtcatggtcatggtcggcgtcgccatgaccgacgacatcggcatgggcgtcacctacctcgccctcctcgccgccttcaaggtccgccccaccttcgccgccggcctcctcctccgcaagctcacctccaaggagctcatgatggccaccatcggcatcaccctcctctcccagtccaccatccccgagaccatcctcgagctcaccgacgccctcgccctcggcatgatggtcctcaagatcgtccgcaacatggagaagtaccagctcgccgtcaccatcatggccatctcctgcgtccccaacgccgtcatcctcctcaacgcctggaaggtctcctgcaccatcctcgccgccgtctccgtctcccccctcctcctcacctcctcccagcagaagaccgactggatccccctcgccctcaccatcaagggcctcaaccccaccgccatcttcctcaccaccctctcccgcacctccaagaagcgctcctggcccctcaacgaggccgtcatggccgtcggcatggtctccatcctcgcctcctccctcctcaagaacgacatccccatgaccggccccctcgtcgccggcggcctcctcaccgtctgctacgtcctcaccggccgctccgccgacctcgagctcgagcgcgccgccgacgtcaagtgggaggaccaggccgagatctccggctcctcccccatcctctccatcaccatctccgaggacggctccatgtccatcaagaacgaggaggaggagcagaccctcaccatcctcatccgcaccggcctcctcgtcatctccggcgtcttccccgtctccatccccatcaccgccgccgcctggtacctctgggaggtcaagaagcagcgcgccggcgtcctctgggacgtcccctcccccccccccgtcggcaaggccgagctcgaggacggcgcctaccgcatcaagcagcgcggcatcctcggctactcccagatcggcgccggcgtctacaaggagggcaccttccacaccatgtggcacgtcacccgcggcgccgtcctcatgcaccgcggcaagcgcatcgagccctcctgggccgacgtcaagaaggacctcatctcctacggcggcggctggaagctcgagggcgagtggaaggagggcgaggaggtccaggtcctcgccctcgagcccggcaagaacccccgcgccgtccagaccaagcccggcctcttcaagaccaacaccggcaccatcggcgccgtctccctcgacttctcccccggcacctccggctcccccatcgtcgaccgcaagggcaaggtcgtcggcctctacggcaacggcgtcgtcacccgctccggcgcctacgtctccgccatcgcccagaccgagaagtccatcgaggacaaccccgagatcgaggacgacatcttccgcaagaagcgcctcaccatcatggacctccaccccggcgccggcaagaccaagcgctacctccccgccatcgtccgcgaggccatcaagcgcggcctccgcaccctcatcctcgcccccacccgcgtcgtcgccgccgagatggaggaggccctccgcggcctccccatccgctaccagacccccgccatccgcgccgagcacaccggccgcgagatcgtcgacctcatgtgccacgccaccttcaccatgcgcctcctctcccccgtccgcgtccccaactacaacctcatcatcatggacgaggcccacttcaccgaccccgcctccatcgccgcccgcggctacatctccacccgcgtcgagatgggcgaggccgccggcatcttcatgaccgccaccccccccggctcccgcgaccccttcccccagtccaacgcccccatcatggacgaggagcgcgagatccccgagcgctcctggaactccggccacgagtgggtcaccgacttcaagggcaagaccgtctggttcgtcccctccatcaaggccggcaacgacatcgccgcctgcctccgcaagaacggcaagaaggtcatccagctctcccgcaagaccttcgactccgagtacgtcaagacccgcgccaacgactgggacttcgtcgtcaccaccgacatctccgagatgggcgccaacttccgcgccgagcgcgtcatcgacccccgccgctgcatgaagcccgtcatcctcaccgacggcgaggagcgcgtcatcctcgccggccccatgcccgtcacccactcctccgccgcccagcgccgcggccgcgtcggccgcaaccccaagaacgagaacgaccagtacatctacatgggcgagcccctcgagaacgacgaggactgcgcccactggaaggaggccaagatgctcctcgacaacatcaacacccccgagggcatcatcccctccatgttcgagcccgagcgcgagaaggtcgacgccatcgacggcgagtaccgcctccgcggcgaggcccgcaagaccttcgtcgacctcatgcgccgcggcgacctccccgtctggctcgcctaccgcgtcgccgccgagggcatcaactacgccgaccgccgctggtgcttcgacggcatcaagaacaaccagatcctcgaggagaacgtcgaggtcgagatctggaccaaggagggcgagcgcaagaagctcaagccccgctggctcgacgcccgcatctactccgaccccctcgccctcaaggagttcaaggagttcgccgccggccgcaagtccctcaccctcaacctcatcaccgagatgggccgcctccccaccttcatgacccagaaggcccgcgacgccctcgacaacctcgccgtcctccacaccgccgaggccggcggccgcgcctacaaccacgccctctccgagctccccgagaccctcgagaccctcctcctcctcaccctcctcgccaccgtcaccggcggcatcttcctcttcctcatgtccggcaagggcatcggcaagatgaccctcggcatgtgctgcatcatcaccgcctccatcctcctctggtacgcccagatccagccccactggatcgccgcctccatcatcctcgagttcttcctcatcgtcctcctcatccccgagcccgagaagcagcgcaccccccaggacaaccagctcacctacgtcgtcatcgccatcctcaccgtcgtcgccgccaccatggccaacgagatgggcttcctcgagaagaccaagaaggacctcggcctcggctccatcaccacccaggagtccgagtccaacatcctcgacatcgacctccgccccgcctccgcctggaccctctacgccgtcgccaccaccttcgtcacccccatgctccgccactccatcgagaactcctccgtcaacgtctccctcaccgccatcgccaaccaggccaccgtcctcatgggcctcggcaagggctggcccctctccaagatggacatcggcgtccccctcctcgccatcggctgctactcccaggtcaaccccatcaccctcaccgccgccctcctcctcctcgtcgcccactacgccatcatcggccccggcctccaggccaaggccacccgcgaggcccagaagcgcgccgccgccggcatcatgaagaaccccaccgtcgacggcatcaccgtcatcgacctcgagcccatcccctacgaccccaagttcgagaagcagctcggccaggtcatgctcctcatcctctgcgtcacccaggtcctcatgatgcgcaccacctgggccctctgcgaggccctcaccctcgccaccggccccatctccaccctctgggagggcaaccccggccgcttctggaacaccaccatcgccgtctccatggccaacatcttccgcggctcctacctcgccggcgccggcctcctcttctccatcatgaagaacaccaccaacacccgccgcggcaccggcaacatcggcgagaccctcggcgagaagtggaagtcccgcctcaacgccctcggcaagtccgagttccagatctacaagaagtccggcatccaggaggtcgaccgcaccctcgccaaggagggcatcaagcgcggcgagaccgaccaccacgccgtctcccgcggctccgccaagctccgctggttcgtcgagcgcaacatggtcacccccgagggcaaggtcgtcgacctcggctgcggccgcggcggctggtcctactactgcggcggcctcaagaacgtccgcgaggtcaagggcctcaccaagggcggccccggccacgaggagcccatccccatgtccacctacggctggaacctcgtccgcctccagtccggcgtcgacgtcttcttcaccccccccgagaagtgcgacaccctcctctgcgacatcggcgagtcctcccccaaccccaccatcgaggccggccgcaccctccgcgtcctcaacctcgtcgagaactggctcaacaacaacacccagttctgcatcaaggtcctcaacccctacatgccctccgtcatcgagaagatggagaccctccagcgcaagtacggcggcgccctcgtccgcaaccccctctcccgcaactccacccacgagatgtactgggtctccaacgccaccggcaacatcgtctcctccgtcaacatgatctcccgcatgctcatcaaccgcttcaccatgaagcacaagaaggccacctacgagcccgacgtcgacctcggctccggcacccgcaacatcggcatcgagtccgagatccccaacctcgacatcatcggcaagcgcatcgagaagatcaagcaggagcacgagacctcctggcactacgaccaggaccacccctacaagacctgggcctaccacggctcctacgagaccaagcagaccggctccgcctcctccatggtcaacggcgtcgtccgcctcctcaccaagccctgggacgtcgtccccatggtcacccagatggccatgaccgacaccacccccttcggccagcagcgcgtcttcaaggagaaggtcgacacccgcacccaggagcccaaggagggcaccaagaagctcatgcgcatcaccgccgagtggctctggaaggagctcggcaagaagaagaccccccgcatgtgcacccgcgaggagttcacccgcaaggtccgctccaacgccgccctcggcgccatcttcaccgacgagaacaagtggaagtccgcccgcgaggccgtcgaggactcccgcttctgggagctcgtcgaccgcgagcgcaacctccacctcgagggcaagtgcgagacctgcgtctacaacatgatgggcaagcgcgagaagaagctcggcgagttcggcaaggccaagggctcccgcgccatctggtacatgtggctcggcgcccgcttcctcgagttcgaggccctcggcttcctcaacgaggaccactggttctcccgcggcaactccctctccggcgtcgagggcgagggcctccaccgcctcggctacatcctccgcgacgtctccaagaaggagggcggcgccatgtacgccgacgacaccgccggctgggacacccgcatcaccctcgaggacctcaagaacgaggagatggtcaccaaccacatgaagggcgagcacaagaagctcgccgaggccatcttcaagctcacctaccagaacaaggtcgtccgcgtccagcgccccaccccccgcggcaccgtcatggacatcatctcccgccgcgaccagcgcggctccggccaggtcggcacctacggcctcaacaccttcaccaacatggaggcccagctcatccgccagatggagggcgagggcatcttcaagtccatccagcacctcaccgtcaccgaggagatcgccgtccagaactggctcgcccgcgtcggccgcgagcgcctctcccgcatggccatctccggcgacgactgcgtcgtcaagcccctcgacgaccgcttcgcctccgccctcaccgccctcaacgacatgggcaaggtccgcaaggacatccagcagtgggagccctcccgcggctggaacgactggacccaggtccccttctgctcccaccacttccacgagctcgtcatgaaggacggccgcgtcctcgtcgtcccctgccgcaaccaggacgagctcatcggccgcgcccgcatctcccagggcgccggctggtccctcaaggagaccgcctgcctcggcaagtcctacgcccagatgtggaccctcatgtacttccaccgccgcgacctccgcctcgccgccaacgccatctgctccgccgtcccctcccactgggtccccacctcccgcaccacctggtccatccacgccaagcacgagtggatgaccaccgaggacatgctcgccgtctggaaccgcgtctggatccaggagaacccctggatgggcgacaagacccccgtcgagtcctgggaggaggtcccctacctcggcaagcgcgaggaccagtggtgcggctccctcatcggcctcacctcccgcgccacctgggccaagaacatccagaccgccatcaaccaggtccgctccctcatcggcaacgaggagtacaccgactacatgccctccatgaagcgcttccgccgcgaggaggaggaggccggcgtcctctgg
